US010718023B2

(12) United States Patent
Huang

(10) Patent No.: US 10,718,023 B2
(45) Date of Patent: Jul. 21, 2020

(54) GENETIC POLYMORPHISMS ASSOCIATED WITH LIVER FIBROSIS, METHODS OF DETECTION AND USES THEREOF

(71) Applicant: CELERA CORPORATION, San Clemente, CA (US)

(72) Inventor: Hongjin Huang, Union City, CA (US)

(73) Assignee: Celera Corporation, San Juan Capistrano, CA (US)

( * ) Notice: Subject to any disclaimer, the term of this patent is extended or adjusted under 35 U.S.C. 154(b) by 0 days.

(21) Appl. No.: 15/964,883

(22) Filed: Apr. 27, 2018

(65) Prior Publication Data

US 2019/0127796 A1     May 2, 2019

Related U.S. Application Data

(60) Continuation of application No. 14/797,998, filed on Jul. 13, 2015, now abandoned, which is a division of application No. 13/764,086, filed on Feb. 11, 2013, now abandoned, which is a continuation of application No. 13/283,344, filed on Oct. 27, 2011, now abandoned, which is a division of application No. 12/886,016, filed on Sep. 20, 2010, now Pat. No. 8,071,302, which is a division of application No. 11/124,367, filed on May 9, 2005, now Pat. No. 7,820,380.

(60) Provisional application No. 60/582,609, filed on Jun. 25, 2004, provisional application No. 60/568,846, filed on May 7, 2004, provisional application No. 60/599,554, filed on Aug. 9, 2004.

(51) Int. Cl.
*C12Q 1/68*     (2018.01)
*C07H 21/04*     (2006.01)
*C12Q 1/6883*     (2018.01)

(52) U.S. Cl.
CPC ...... *C12Q 1/6883* (2013.01); *C12Q 2600/118* (2013.01); *C12Q 2600/156* (2013.01); *C12Q 2600/158* (2013.01); *C12Q 2600/172* (2013.01)

(58) Field of Classification Search
None
See application file for complete search history.

(56) References Cited

PUBLICATIONS

Pennisi E. Science; Sep. 18, 1998; 281,5384, p. 1787-1789 (Year: 1998).*
Hegele R.A. Arterioscler Thromb Vasc Biol. 2002;22:1058-1061 (Year: 2002).*
WICVAR (dbSNP ss3176849, rs1140409, Jun. 28, 2001). (Year: 2001).*
Syvanen (Nature Reviews, Dec. 2001, vol. 2, pp. 930-942). (Year: 2001).*

* cited by examiner

*Primary Examiner* — Jeanine A Goldberg
(74) *Attorney, Agent, or Firm* — Celera Corporation

(57) ABSTRACT

The present invention is based on the discovery of genetic polymorphisms that are associated with liver fibrosis and related pathologies. In particular, the present invention relates to nucleic acid molecules containing the polymorphisms, variant proteins encoded by such nucleic acid molecules, reagents for detecting the polymorphic nucleic acid molecules and proteins, and methods of using the nucleic acid and proteins as well as methods of using reagents for their detection.

18 Claims, 1 Drawing Sheet
Specification includes a Sequence Listing.

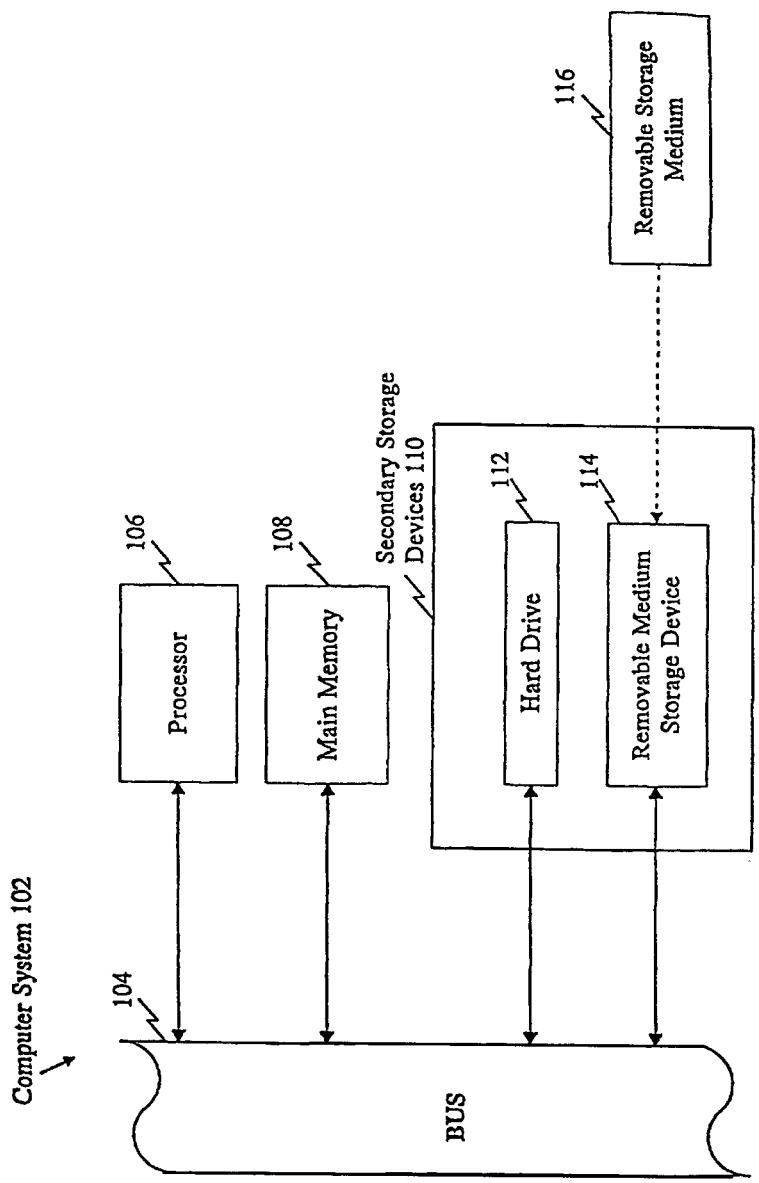

GENETIC POLYMORPHISMS ASSOCIATED WITH LIVER FIBROSIS, METHODS OF DETECTION AND USES THEREOF

CROSS-REFERENCE TO RELATED APPLICATIONS

This application is a continuation application of U.S. non-provisional application Ser. No. 14/797,998, filed Jul. 13, 2015, which is a divisional application of U.S. non-provisional application Ser. No. 13/764,086, filed on Feb. 11, 2013, which is a continuation application of U.S. non-provisional application Ser. No. 13/283,344, filed Oct. 27, 2011, which is a divisional application of U.S. non-provisional application Ser. No. 12/886,016, filed Sep. 20, 2010 (and issued as U.S. Pat. No. 8,071,302 on Dec. 6, 2011), which claims priority to U.S. non-provisional application Ser. No. 11/124,367, filed on May 9, 2005 (and issued as U.S. Pat. No. 7,820,380 on Oct. 26, 2010), which claims priority to U.S. provisional application Ser. No. 60/599,554, filed on Aug. 9, 2004, U.S. provisional application Ser. No. 60/582,609, filed on Jun. 24, 2004 and U.S. provisional application Ser. Nos. 60/568,846, filed on May 7, 2004, the contents of each of which are hereby incorporated by reference in their entirety into this application.

FIELD OF THE INVENTION

The present invention is in the field of fibrosis diagnosis and therapy and in particular liver fibrosis diagnosis and therapy, and more particularly, liver fibrosis associated with hepatitis C virus (HCV) infection. More specifically, the present invention relates to specific single nucleotide polymorphisms (SNPs) in the human genome, and their association with liver fibrosis and related pathologies. Based on differences in allele frequencies in the patient population with advanced or bridging fibrosis/cirrhosis relative to individuals with no or minimal fibrosis, the naturally-occurring SNPs disclosed herein can be used as targets for the design of diagnostic reagents and the development of therapeutic agents, as well as for disease association and linkage analysis. In particular, the SNPs of the present invention are useful for identifying an individual who is at an increased or decreased risk of developing liver fibrosis and for early detection of the disease, for providing clinically important information for the prevention and/or treatment of liver fibrosis, and for screening and selecting therapeutic agents. The SNPs disclosed herein are also useful for human identification applications. Methods, assays, kits, and reagents for detecting the presence of these polymorphisms and their encoded products are provided.

BACKGROUND OF THE INVENTION

Fibrosis

Fibrosis is a quantitative and qualitative change in the extracellular matrix that surrounds cells as a response to tissue injury. The trauma that generates fibrosis is varied and includes radiological trauma (i.e., x-ray, gamma ray, etc.), chemical trauma (ie., radicals, ethanol, phenols, etc.) viral infection and physical trauma. Fibrosis encompasses pathological conditions in a variety of tissues such as pulmonary fibrosis, retroperitoneal fibrosis, epidural fibrosis, congenital fibrosis, focal fibrosis, muscle fibrosis, massive fibrosis, radiation fibrosis (e.g. radiation induced lung fibrosis), liver fibrosis and cardiac fibrosis.

Liver Fibrosis in HCV-Infected Subjects

HCV affects about 4 million people in the United States and more than 170 million people worldwide. Approximately 85% of the infected individuals develop chronic hepatitis, and up to 20% progress to bridging fibrosis/cirrhosis, which is end-stage severe liver fibrosis and is generally irreversible (Lauer et al. 2001, *N Eng J Med* 345: 41-52). HCV infection is the major cause of cirrhosis and hepatocellular carcinoma (HCC), and accounts for one third of liver transplantations. The interval between infection and the development of cirrhosis may exceed 30 years but varies widely among individuals. Based on fibrosis progression rate, chronic HCV patients can be roughly divided into three groups (Poynard et al 1997, *Lancet* 349: 825-832): rapid, median, and slow fibrosers.

Previous studies have indicated that host factors may play a role in the progression of fibrosis, and these include age at infection, duration of infection, alcohol consumption, and gender. However, these host factors account for only 17%-29% of the variability in fibrosis progression (Poynard et al., 1997, *Lancet* 349: 825-832; Wright et al *Gut.* 2003, 52(4): 574-9). Viral load or viral genotype has not shown significant correlation with fibrosis progression (Poynard et al., 1997, *Lancet* 349: 825-832). Thus, other factors, such as host genetic factors, are likely to play an important role in determining the rate of fibrosis progression.

Recent studies suggest that some genetic polymorphisms influence the progression of fibrosis in patients with HCV infection (Powell et al. *Hepatology* 31(4): 828-33, 2000), autoimmune chronic cholestasis (Tanaka et al. *J. Infec. Dis.* 187:1822-5, 2003), alcohol induced liver diseases (Yamauchi et al., *J. Hepatology* 23(5):519-23, 1995), and non-alcoholic fatty liver diseases (Bernard et al. *Diabetologia* 2000, 43(8):995-9). However, none of these genetic polymorphisms have been integrated into clinical practice for various reasons (Bataller et al *Hepatology.* 2003, 37(3):493-503). For example, limitations in study design, such as small study populations, lack of replication sample sets, and lack of proper control groups have contributed to contradictory results; an example being the conflicting results reported on the role of mutations in the hemochromatosis gene (HFE) on fibrosis progression in HCV-infected patients (Smith et al., *Hepatology.* 1998, 27(6):1695-9; Thorburn et al., *Gut.* 2002, 50(2):248-52).

Currently, there is no diagnostic test that can identify patients who are predisposed to developing liver damage from chronic HCV infection, despite the large variability in fibrosis progression rate among HCV patients. Furthermore, diagnosis of fibrosis stage (early, middle or late) and monitoring of fibrosis progression is currently accomplished by liver biopsy, which is invasive, painful, and costly, and generally must be performed multiple times to assess fibrosis status. The discovery of genetic markers which are useful in identifying HCV-infected individuals who are at increased risk for advancing from early stage fibrosis to cirrhosis and/or HCC may lead to, for example, better therapeutic strategies, economic models, and health care policy decisions.

SNPs

The genomes of all organisms undergo spontaneous mutation in the course of their continuing evolution, generating variant forms of progenitor genetic sequences (Gusella, *Ann. Rev. Biochem.* 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than $\frac{1}{100}$ or $\frac{1}{1000}$ members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms", *Am J Hum Genet* 2002 October; 71(4):854-62).

A synonymous codon change, or silent mutation/SNP (terms such as "SNP", "polymorphism", "mutation", "mutant", "variation", and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers", or "di-allelic markers".

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. *Science* 293, 489-493, 20 Jul. 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as liver fibrosis and related pathologies and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to liver fibrosis, increased or decreased risk of developing bridging fibrosis/cirrhosis, and progression of liver fibrosis. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. (Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16: 3).

SUMMARY OF THE INVENTION

The present invention relates to the identification of novel SNPs, unique combinations of such SNPs, and haplotypes of SNPs that are associated with liver fibrosis and in particular the increased or decreased risk of developing bridging fibrosis/cirrhosis, and the rate of progression of liver fibrosis. The polymorphisms disclosed herein are directly useful as targets for the design of diagnostic reagents and the development of therapeutic agents for use in the diagnosis and treatment of liver fibrosis and related pathologies.

Based on the identification of SNPs associated with liver fibrosis, the present invention also provides methods of detecting these variants as well as the design and preparation of detection reagents needed to accomplish this task. The invention specifically provides, for example, novel SNPs in genetic sequences involved in liver fibrosis and related pathologies, isolated nucleic acid molecules (including, for example, DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing liver fibrosis based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment (or more or less likely to experience undesirable side effects from a treatment, etc.), methods of screening for compounds useful in the treatment of a disorder associated with a variant gene/protein, compounds identified by these methods, methods of treating disorders mediated by a variant gene/protein, methods of using the novel SNPs of the present invention for human identification, etc.

In Tables 1-2, the present invention provides gene information, transcript sequences (SEQ ID NOS:1-261), encoded amino acid sequences (SEQ ID NOS:262-522), genomic sequences (SEQ ID NOS:4999-5321), transcript-based context sequences (SEQ ID NOS:523-4998) and genomic-based context sequences (SEQ ID NOS:5322-34256) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The transcript sequences (SEQ ID NOS:1-261), amino acid sequences (SEQ ID NOS:262-522), genomic sequences (SEQ ID NOS: 4999-5321), transcript-based SNP context sequences (SEQ ID NOS: 523-4998), and genomic-based SNP context sequences (SEQ ID NOS:5322-34256) are also provided in the Sequence Listing.

In a specific embodiment of the present invention, SNPs that occur naturally in the human genome are provided as isolated nucleic acid molecules. These SNPs are associated with liver fibrosis and related pathologies. In particular the SNPs are associated with either an increased or decreased risk of developing bridging fibrosis/cirrhosis and affect the rate of progression of liver fibrosis. As such, they can have a variety of uses in the diagnosis and/or treatment of liver fibrosis and related pathologies. One aspect of the present invention relates to an isolated nucleic acid molecule comprising a nucleotide sequence in which at least one nucleotide is a SNP disclosed in Tables 3 and/or 4. In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of developing liver fibrosis by detecting the presence or absence of one or more SNP alleles disclosed herein. In another embodiment, a method for diagnosis of liver fibrosis and related pathologies by detecting the presence or absence of one or more SNP alleles disclosed herein is provided.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of liver fibrosis and related pathologies.

An aspect of this invention is a method for treating liver fibrosis in a human subject wherein said human subject harbors a SNP, gene, transcript, and/or encoded protein identified in Tables 1-2, which method comprises administering to said human subject a therapeutically or prophylactically effective amount of one or more agents counteracting the effects of the disease, such as by inhibiting (or stimulating) the activity of the gene, transcript, and/or encoded protein identified in Tables 1-2.

Another aspect of this invention is a method for identifying an agent useful in therapeutically or prophylactically treating liver fibrosis and related pathologies in a human subject wherein said human subject harbors a SNP, gene, transcript, and/or encoded protein identified in Tables 1-2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating liver fibrosis and related pathologies in a human subject, which method comprises:

(i) determining that said human subject harbors a SNP, gene, transcript, and/or encoded protein identified in Tables 1-2, and (ii) administering to said subject a therapeutically or prophylactically effective amount of one or more agents counteracting the effects of the disease.

Many other uses and advantages of the present invention will be apparent to those skilled in the art upon review of the detailed description of the preferred embodiments herein. Solely for clarity of discussion, the invention is described in the sections below by way of non-limiting examples.

Description of the Files Contained on the CD-R Named CL001519CDR

The CD-R named CL001519CDR contains the following five text (ASCII) files:

1) File SEQLIST_1519DIV2.txt provides the Sequence Listing. The Sequence Listing provides the transcript sequences (SEQ ID NOS:1-261) and protein sequences (SEQ ID NOS:262-522) as shown in Table 1, and genomic sequences (SEQ ID NOS:4999-5321) as shown in Table 2, for each liver fibrosis-associated gene that contains one or more SNPs of the present invention. Also provided in the Sequence Listing are context sequences flanking each SNP, including both transcript-based context sequences as shown in Table 1 (SEQ ID NOS:523-4998) and genomic-based context sequences as shown in Table 2 (SEQ ID NOS:5322-34256). The context sequences generally provide 100 bp upstream (5') and 100 bp downstream (3') of each SNP, with the SNP in the middle of the context sequence, for a total of 200 bp of context sequence surrounding each SNP.

2) File TABLE1_1519DIV.txt provides Table 1. File TABLE1_1519DIV.txt is 268 KB in size, and was created on 7/21/10.

3) File TABLE2_1519DIV.txt provides Table 2. File TABLE2_1519DIV.txt is 249 KB in size, and was created on 7/21/10.

4) File TABLE3_1519.txt provides Table 3. File TABLE3_1519.txt is 21 KB in size, and was created on 5/5/05.

5) File TABLE4_1519.txt provides Table 4. File TABLE4_1519.txt is 28 KB in size, and was created on 5/5/05.

The material contained on the CD-R labeled CL001519CDR is hereby incorporated by reference pursuant to 37 CFR 1.77(b)(4).

Description of Table 1 and Table 2

Table 1 and Table 2 (both provided on the CD-R) disclose the SNP and associated gene/transcript/protein information of the present invention. For each gene, Table 1 and Table 2 each provide a header containing gene/transcript/protein information, followed by a transcript and protein sequence (in Table 1) or genomic sequence (in Table 2), and then SNP information regarding each SNP found in that gene/transcript.

NOTE: SNPs may be included in both Table 1 and Table 2; Table 1 presents the SNPs relative to their transcript sequences and encoded protein sequences, whereas Table 2 presents the SNPs relative to their genomic sequences (in some instances Table 2 may also include, after the last gene sequence, genomic sequences of one or more intergenic regions, as well as SNP context sequences and other SNP information for any SNPs that lie within these intergenic regions). SNPs can readily be cross-referenced between Tables based on their hCV (or, in some instances, hDV) identification numbers.

The gene/transcript/protein information includes:
a gene number (1 through n, where n=the total number of genes in the Table)
a Celera hCG and UID internal identification numbers for the gene
a Celera hCT and UID internal identification numbers for the transcript (Table 1 only)
a public Genbank accession number (e.g., RefSeq NM number) for the transcript (Table 1 only)
a Celera hCP and UID internal identification numbers for the protein encoded by the hCT transcript (Table 1 only)
a public Genbank accession number (e.g., RefSeq NP number) for the protein (Table 1 only)
an art-known gene symbol
an art-known gene/protein name
Celera genomic axis position (indicating start nucleotide position-stop nucleotide position)
the chromosome number of the chromosome on which the gene is located
an OMIM (Online Mendelian Inheritance in Man; Johns Hopkins University/NCBI) public reference number for obtaining further information regarding the medical significance of each gene
alternative gene/protein name(s) and/or symbol(s) in the OMIM entry NOTE: Due to the presence of alternative splice forms, multiple transcript/protein entries can be provided for a single gene entry in Table 1; i.e., for a single Gene Number, multiple entries may be provided in series that differ in their transcript/protein information and sequences.

Following the gene/transcript/protein information is a transcript sequence and protein sequence (in Table 1), or a genomic sequence (in Table 2), for each gene, as follows:
transcript sequence (Table 1 only) (corresponding to SEQ ID NOS:1-261 of the Sequence Listing), with SNPs identified by their IUB codes (transcript sequences can include 5' UTR, protein coding, and 3' UTR regions). (NOTE: If there are differences between the nucleotide sequence of the hCT transcript and the corresponding public transcript sequence identified by the Genbank accession number, the hCT transcript sequence (and encoded protein) is provided, unless the public sequence is a RefSeq transcript sequence identified by an NM number, in which case the RefSeq NM transcript sequence (and encoded protein) is provided. However, whether the hCT transcript or RefSeq NM transcript is used as the transcript sequence, the disclosed SNPs are represented by their IUB codes within the transcript.)
the encoded protein sequence (Table 1 only) (corresponding to SEQ ID NOS:262-522 of the Sequence Listing)
the genomic sequence of the gene (Table 2 only), including 6 kb on each side of the gene boundaries (i.e., 6 kb on the 5' side of the gene plus 6 kb on the 3' side of the gene) (corresponding to SEQ ID NOS:4999-5321 of the Sequence Listing).

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (and such SNPs are identified as "INTERGENIC" for SNP type).

NOTE: The transcript, protein, and transcript-based SNP context sequences are provided in both Table 1 and in the Sequence Listing. The genomic and genomic-based SNP context sequences are provided in both Table 2 and in the Sequence Listing. SEQ ID NOS are indicated in Table 1 for each transcript sequence (SEQ ID NOS:1-261), protein sequence (SEQ ID NOS:262-522), and transcript-based SNP context sequence (SEQ ID NOS:523-4998), and SEQ ID NOS are indicated in Table 2 for each genomic sequence (SEQ ID NOS:4999-5321), and genomic-based SNP context sequence (SEQ ID NOS:5322-34256).

The SNP information includes:

- context sequence (taken from the transcript sequence in Table 1, and taken from the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS:523-4998; the genomic-based SNP context sequences in Table 2 are provided in the Sequence Listing as SEQ ID NOS: 5322-34256).
- Celera hCV internal identification number for the SNP (in some instances, an "hDV" number is given instead of an "hCV" number)
- SNP position [position of the SNP within the given transcript sequence (Table 1) or within the given genomic sequence (Table 2)]
- SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"= SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs)) (NOTE: multiple "Applera" source entries for a single SNP indicate that the same SNP was covered by multiple overlapping amplification products and the re-sequencing results (e.g., observed allele counts) from each of these amplification products is being provided)
- Population/allele/allele count information in the format of [population1(first_allele,count|second_allele,count) population2(first_allele,count|second_allele,count) total (first_allele,total count|second_allele,total count)]. The information in this field includes populations/ethnic groups in which particular SNP alleles have been observed ("cau"=Caucasian, "his"= Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["-" in the allele field represents a deletion allele of an insertion/deletion ("indel") polymorphism (in which case the corresponding insertion allele, which may be comprised of one or more nucleotides, is indicated in the allele field on the opposite side of the "|"); "-" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC1"=human individual DNA (anonymized samples) from 24 individuals of self-described PACIFIC RIM heritage; "CAUL 1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library. Six male and 6 female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"= Caucasians—12 DNAs from Corielle cell repositories that are from the CEPH/UTAH library. Six male and 6 female.

NOTE: For SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

(NOTE: semicolons separate population/allele/count information corresponding to each indicated SNP source; i.e., if four SNP sources are indicated, such as "Celera", "dbSNP", "HGBASE", and "HGMD", then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information)

- SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary]

Protein coding information (Table 1 only), where relevant, in the format of [protein SEQ ID NO:#, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3 and Table 4

Tables 3 and 4 (both provided on the CD-R) provide a list of a subset of SNPs from Table 1 (in the case of Table 3) or Table 2 (in the case of Table 4) for which the SNP source falls into one of the following three categories: 1) SNPs for which the SNP source is only "Applera" and none other, 2) SNPs for which the SNP source is only "Celera Diagnostics" and none other, and 3) SNPs for which the SNP source is both "Applera" and "Celera Diagnostics" but none other.

These SNPs have not been observed in any of the public databases (dbSNP, HGBASE, and HGMD), and were also not observed during shotgun sequencing and assembly of the Celera human genome sequence (i.e., "Celera" SNP source). Tables 3 and 4 provide the hCV identification number (or hDV identification number for SNPs having "Celera Diagnostics" SNP source) and the SEQ ID NO of the context sequence for each of these SNPs.

Description of Table 5

Table 5 provides sequences (SEQ ID NOS: 34257-34458) of primers that have been synthesized and used in the laboratory to carry out allele-specific PCR reactions in order to assay the SNPs disclosed in Tables 6 and 7 during the course of association studies to verify the association of these SNPs with liver fibrosis.

Table 5 provides the following:
the column labeled "Marker" provides an hCV identification number for each SNP site
the column labeled "Alleles" designates the two alternative alleles at the SNP site identified by the hCV identification number that are targeted by the allele-specific primers (the allele-specific primers are shown as "Sequence A" and "Sequence B") [NOTE: Alleles may be presented in Table 5 based on a different orientation (i.e., the reverse complement) relative to how the same alleles are presented in Tables 1, 2, 6, and 7].
the column labeled "Sequence A (allele-specific primer)" provides an allele-specific primer that is specific for an allele designated in the "Alleles" column
the column labeled "Sequence B (allele-specific primer)" provides an allele-specific primer that is specific for the other allele designated in the "Alleles" column
the column labeled "Sequence C (common primer)" provides a common primer that is used in conjunction with each of the allele-specific primers (the "Sequence A" primer and the "Sequence B" primer) and which hybridizes at a site away from the SNP position.

All primer sequences are given in the 5' to 3' direction.

Each of the nucleotides designated in the "Alleles" column matches or is the reverse complement of (depending on the orientation of the primer relative to the designated allele) the 3' nucleotide of the allele-specific primer (either "Sequence A" or "Sequence B") that is specific for that allele.

Description of Table 6

Table 6 provides results of statistical analyses for SNPs disclosed in Tables 1-4 (SNPs can be cross-referenced between tables based on their hCV identification numbers), and the association of these SNPs with early and late stages of fibrosis (minimal or moderate to severe fibrosis). The statistical results shown in Table 6 provide support for the association of a SNP with minimal to severe fibrosis. Table 6 shows the association of this SNP with fibrosis is supported by p-values<0.05 in a genotype association based on ordinal (ord) (major homozygotes, heterozygotes and minor homozygotes) or dominant/recessive (dom) modes (major homozygotes vs. heterozygotes and minor homozygotes) of inheritance.

Table 6 presents statistical associations of the SNP with the trial endpoint. The column labeled "Marker" presents the SNP as identified by its unique identifier number and its mode of association with the fibrosis stage endpoint. The column labeled "Gene symbol" presents the common gene name of the gene containing the SNP. The data obtained from the individual sample sets are presented in two groups of columns. The groups of columns labeled "Stanford Samples" means the samples were obtained from patients at Stanford. This sample set contains samples obtained from patients that had extreme cases of fibrosis. 62% of the patients had a minimum fibrosis stage (level 0-2) (controls) and 38% had a severe fibrosis stage (level 3-4) (cases). The groups of columns labeled "UCSF Samples" means the samples were obtained from a study performed at the University of California, San Francisco. These samples were obtained from patients that had a variety of stages of fibrosis including minimal, moderate and severe stages of fibrosis (46%, 26% and 28% respectively), which reflects the distribution of fibrosis patients in clinics. The column labeled "OR" indicates the Odds Ratio, an approximation of the relative risk for an individual for the defined endpoint associated with the SNP. ORs less than 1 indicate the risk allele is protective for the defined endpoint, and ORs greater than 1 indicate the risk allele increases the risk of having the defined endpoint. The columns labeled "LCL" and "UCL" give the lower and upper confidence levels of the ORs. The column labeled "p val" indicates the results of either the chi-square test (Dom) or the Fisher Exact test (Ord) to determine if the qualitative phenotype is a function of the SNP genotype.

Description of Table 7

Table 7 provides results of statistical analyses for SNPs disclosed in Tables 1-4 (SNPs can be cross-referenced between tables based on their hCV identification numbers), and the association of these SNPs with mild or severe fibrosis stage. The statistical results shown in Table 7 provide support for the association of these SNPs with bridging fibrosis/cirrhosis. For example, the statistical results provided in Table 7 show that the association of these SNPs with is supported by p-values<0.1 in an allelic association test in the University of California (UCSF) and the Virginia Commonwealth University (VCU) sample sets in at least one of the following strata; all patients (A), Caucasian only (C), or other than Caucasian (O). Additional SNP association with bridging fibrosis/cirrhosis is seen in the sample sets obtained from the University of Illinois, Chicago (UIC) and Stanford University (Stanford).

Table 7 presents statistical associations of SNPs with trial endpoints. The column labeled "Marker" presents each SNP as identified by its unique identifier number. The column labeled "Risk allele" presents the risk allele for each of the identified SNPs. The risk allele may also be presented in the Tables 1-4 as the reverse complement of the allele presented in Table 6. The column labeled "Strata" indicates the group of individuals in which the association was observed. "A" indicates that the association was observed in all individuals, "C" indicates that the association was observed in Caucasians, "O" indicates the association was observed in other than Caucasians. The groups of columns labeled "UCSF" means the samples were obtained from the University of California, San Francisco. Among the 537 patients from UCSF, the samples had minimal (stage 0-1, 52%), moderate (stage 2, 23%) or severe (stage 3-4, 25%) fibrosis. The groups of columns labeled "VCU" means the samples were obtained from the Virginia Commonwealth University. These samples were obtained from 483 patients that had minimal (stage 0-1, 18%), moderate (stage 2, 34%) or severe (stage 3-4, 48%) fibrosis. The groups of columns labeled "UIC" means the samples were obtained from the University of Illinois, Chicago. These samples were obtained from 115 patients that had minimal (stage 0-1, 29%), moderate (stage 2, 30%) or severe (stage 3-4, 41%) fibrosis. The groups of columns labeled "Stanford" means the samples were obtained from Stanford University. These samples were obtained from extreme cases, 62% contained minimal (stage 0-1) fibrosis and 38% contained severe (stage 3-4) fibrosis. The column labeled "CT AF" gives the control allele frequency of that SNP in that stratum. The column labeled "CASE AF" gives the case allele frequency of that SNP in that stratum. The column labeled "OR" indicates an approximation of the relative risk for an individual for the defined endpoint associated with the SNP. ORs less than 1 indicate the risk allele is protective for the defined endpoint, and ORs greater than 1 indicate the risk allele increases the risk of having the defined endpoint. The column labeled "p_2tail" indicates the p-value generated by the Fisher Exact test (allelic association) to determine if the qualitative phenotype is a function of the SNP genotype and is either a protective or risk allele in the UCSF sample set. The column labeled "p_1tail" indicates the p-value generated by the Fisher Exact test to determine if the qualitative phenotype is a function of the SNP genotype in the VCU, UIC or Stanford samples and the OR is going in the same direction as the OR for that SNP in the UCSF sample.

DESCRIPTION OF THE FIGURE

FIG. 1 provides a diagrammatic representation of a computer-based discovery system containing the SNP information of the present invention in computer readable form.

DETAILED DESCRIPTION OF THE INVENTION

The present invention provides SNPs associated with liver fibrosis and related pathologies, nucleic acid molecules containing SNPs, methods and reagents for the detection of the SNPs disclosed herein, uses of these SNPs for the development of detection reagents, and assays or kits that utilize such reagents. The liver fibrosis-associated SNPs disclosed herein are useful for diagnosing, screening for, and evaluating predisposition to liver fibrosis, including an increased or decreased risk of developing bridging fibrosis/cirrhosis, the rate of progression of fibrosis, and related pathologies in humans. Furthermore, such SNPs and their encoded products are useful targets for the development of therapeutic agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with liver fibrosis, as well as combinations of SNPs and haplotypes in genetic regions associated with liver fibrosis, polymorphic/variant transcript sequences (SEQ ID NOS:1-261) and genomic sequences (SEQ ID NOS:4999-5321) containing SNPs, encoded amino acid sequences (SEQ ID NOS: 262-522), and both transcript-based SNP context sequences (SEQ ID NOS: 523-4998) and genomic-based SNP context sequences (SEQ ID NOS:5322-34256) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing liver fibrosis, methods of screening for compounds useful for treating disorders associated with a variant gene/protein such as liver fibrosis, compounds identified by these screening methods, methods of using the disclosed SNPs to select a treatment strategy, methods of treating a disorder associated with a variant gene/protein (i.e., therapeutic methods), and methods of using the SNPs of the present invention for human identification.

The present invention provides novel SNPs associated with liver fibrosis and related pathologies, as well as SNPs that were previously known in the art, but were not previously known to be associated with liver fibrosis. Accordingly, the present invention provides novel compositions and methods based on the novel SNPs disclosed herein, and also provides novel methods of using the known, but previously unassociated, SNPs in methods relating to liver fibrosis (e.g., for diagnosing liver fibrosis, etc.). In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD). Novel SNPs for which the SNP source is only "Applera" and none other, i.e., those that have not been observed in any public databases and which were also not observed during shotgun sequencing and assembly of the Celera human genome sequence (i.e., "Celera" SNP source), are indicated in Tables 3-4.

Particular SNP alleles of the present invention can be associated with either an increased risk of having or developing liver fibrosis and related pathologies, or a decreased risk of having or developing liver fibrosis. SNP alleles that are associated with a decreased risk of having or developing liver fibrosis may be referred to as "protective" alleles, and SNP alleles that are associated with an increased risk of having or developing liver fibrosis may be referred to as "susceptibility" alleles, "risk" alleles, or "risk factors". Thus, whereas certain SNPs (or their encoded products) can be assayed to determine whether an individual possesses a SNP allele that is indicative of an increased risk of having or developing liver fibrosis (i.e., a susceptibility allele), other SNPs (or their encoded products) can be assayed to determine whether an individual possesses a SNP allele that is indicative of a decreased risk of having or developing liver fibrosis (i.e., a protective allele). Similarly, particular SNP alleles of the present invention can be associated with either an increased or decreased likelihood of responding to a particular treatment or therapeutic compound, or an increased or decreased likelihood of experiencing toxic effects from a particular treatment or therapeutic compound. The term "altered" may be used herein to encompass either of these two possibilities (e.g., an increased or a decreased risk/likelihood).

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type", "reference", or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e., a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide", "peptide", and "protein" are used interchangeably.

Isolated Nucleic Acid Molecules
And Snp Detection Reagents & Kits

Tables 1 and 2 provide a variety of information about each SNP of the present invention that is associated with liver fibrosis, including the transcript sequences (SEQ ID NOS: 1-261), genomic sequences (SEQ ID NOS:4999-5321), and protein sequences (SEQ ID NOS:262-522) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:523-4998 correspond to transcript-based SNP context sequences disclosed in Table 1, and SEQ ID NOS:5322-34256 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Preferred isolated nucleic acid molecules contain one or more SNPs identified in Table 3 and/or Table 4. Isolated nucleic acid molecules containing one or more SNPs disclosed in at least one of Tables 1-4 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated". Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are provided in Table 1 and in the Sequence Listing (SEQ ID NOS: 1-261), and polymorphic genomic sequences are provided in Table 2 and in the Sequence Listing (SEQ ID NOS:4999-5321). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences provided in Tables 1-2 (transcript sequences are provided in Table 1 as SEQ ID NOS: 1-261, genomic sequences are provided in Table 2 as SEQ ID NOS:4999-5321, transcript-based SNP context sequences are provided in Table 1 as SEQ ID NO:523-4998, and genomic-based SNP context sequences are provided in Table 2 as SEQ ID NO:5322-34256) and their complements. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; *PCR Technology: Principles and Applications for DNA Amplification*, ed. H. A. Erlich, Freeman Press, NY, NY, 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA) (U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are provided in Table 1 as SEQ ID NOS:1-261, genomic sequences are provided in Table 2 as SEQ ID NOS:4999-5321, transcript-based SNP context sequences are provided in Table 1 as SEQ ID NO:523-4998, and genomic-based SNP context sequences are provided in Table 2 as SEQ ID NO:5322-34256), or any nucleic acid molecule that encodes any of the variant proteins provided in Table 1 (SEQ ID NOS:262-522). A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences shown in Table 1 and/or Table 2 (transcript sequences are provided in Table 1 as SEQ ID NOS:1-261, genomic sequences are provided in Table 2 as SEQ ID NOS:4999-5321, transcript-based SNP context sequences are provided in Table 1 as SEQ ID NO:523-4998, and genomic-based SNP context sequences are provided in Table 2 as SEQ ID NO:5322-34256), or any nucleic acid molecule that encodes any of the variant proteins provided in Table 1 (SEQ ID NOS:262-522). A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are provided in Table 1 as SEQ ID NOS:1-261, genomic sequences are provided in Table 2 as SEQ ID NOS:4999-5321, transcript-based SNP context sequences are provided in Table 1 as SEQ ID NO:523-4998, and genomic-based SNP context sequences are provided in Table 2 as SEQ ID NO:5322-34256), or any nucleic acid molecule that encodes any of the variant proteins provided in Table 1 (SEQ ID NOS:262-522). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol.* 1997 June; 15(6):224-9, and Hyrup et al., "Peptide nucleic acids (PNA): synthesis, properties and potential applications", *Bioorg Med Chem.* 1996 January; 4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences shown in Tables 1-2, and can encode a polypeptide that varies to some degree from the specific polypeptide sequences shown in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215:403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol. Biol.* 25, 365-389 (1994)) and KERR (Dufresne et al., *Nat Biotechnol* 2002 December; 20(12):1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (provided in Table 1 as SEQ ID NOS: 1-261), genomic sequences (provided in Table 2 as SEQ ID NOS:4999-5321), and context sequences (transcript-based context sequences are provided in Table 1 as SEQ ID NOS:523-4998; genomic-based context sequences are provided in Table 2 as SEQ ID NOS:5322-34256), can be used for the design of SNP detection reagents. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs provided in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences provided in Table 1 and/or Table 2 (transcript-based context sequences are provided in Table 1 as SEQ ID NOS:523-4998; genomic-based context sequences are provided in Table 2 as SEQ ID NOS:5322-34256). Another example of a detection reagent is a primer which acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-261), genomic sequences (SEQ ID NOS:4999-5321), and SNP context sequences (transcript-based context sequences are provided in Table 1 as SEQ ID NOS:523-4998; genomic-based context sequences are provided in Table 2 as SEQ ID NOS:5322-34256) disclosed in the Sequence Listing and in Tables 1-2. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm which starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides which detect single nucleotide variations in target sequences may be referred to by such terms as "allele-specific oligonucleotides", "allele-specific probes", or "allele-specific primers". The design and use of allele-specific probes for analyzing polymorphisms is described in, e.g., *Mutation Detection A Practical Approach*, ed. Cotton et al. Oxford University Press, 1998; Saiki et al., *Nature* 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: Prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment which is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are limited to, the phosphotriester method described by Narang et al., 1979, Methods in Enzymology 68:90; the phosphodiester method described by Brown et al., 1979, Methods in Enzymology 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118,801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays", "microarrays", and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; *Nat. Biotech.* 14: 1675-1680) and Schena, M. et al. (1996; *Proc. Natl. Acad. Sci.* 93: 10614-10619), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", *Biotechnol Annu Rev.* 2002; 8:85-101; Sosnowski et al., "Active microelectronic array system for DNA hybridization, genotyping and pharmacogenomic applications", *Psychiatr Genet.* 2002 December; 12(4):181-92; Heller, "DNA microarray technology: devices, systems, and applications", *Annu Rev Biomed Eng.* 2002; 4:129-53. Epub 2002 Mar. 22; Kolchinsky et al., "Analysis of SNPs and other genomic variations using gel-based chips", *Hum Mutat.* 2002 April; 19(4):343-60; and McGall et al., "High-density genechip oligonucleotide probe arrays", *Adv Biochem Eng Biotechnol.* 2002; 77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology*, John Wiley & Sons, N.Y. (1989), 6.3.1-6.3.6.

In other embodiments, the arrays are used in conjunction with chemiluminescent detection technology. The following patents and patent applications, which are all hereby incorporated by reference, provide additional information pertaining to chemiluminescent detection: U.S. patent application Ser. Nos. 10/620,332 and 10/620,333 describe chemiluminescent approaches for microarray detection; U.S. Pat. Nos. 6,124,478, 6,107,024, 5,994,073, 5,981,768, 5,871,938, 5,843,681, 5,800,999, and 5,773,628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", *Adv Drug Deliv Rev.* 2003 Feb. 24; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micromachined channels and to change the liquid flow rate for pumping across different sections of the microchip. See, for example, U.S. Pat. No. 6,153,073, Dubrow et al., and U.S. Pat. No. 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially in the diagnosis and treatment of liver fibrosis and related pathologies. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule provided in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is at risk for liver fibrosis and related pathologies or has developed early stage liver fibrosis. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences provided in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides.

The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in screening for liver fibrosis or related pathologies, or determining predisposition thereto, or determining responsiveness to a form of treatment, or in genome mapping or SNP association analysis, etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5(2): 43-60; Shi, "Technologies for individual genotyping: detection of genetic polymorphisms in drug targets and disease genes", *Am J Pharmacogenomics.* 2002; 2(3):197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May; 6(3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol.* 217:286-295 (1992)), comparison of the electrophoretic mobility of variant and wild type nucleic acid molecules (Orita et al., *PNAS* 86:2766 (1989); Cotton et al., *Mutat. Res.* 285:125-144 (1993); and Hayashi et al., *Genet. Anal. Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and 51 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in diagnostic assays for liver fibrosis and related pathologies, and can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6,054,564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array; U.S. application Ser. No. 01/17329 (and Ser. No. 09/584, 905) describes OLA (or LDR) followed by PCR, wherein zipcodes are incorporated into OLA probes, and amplified PCR products are determined by electrophoretic or universal zipcode array readout; U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization-Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003; 17(11):1195-202.

The following references provide further information describing mass spectrometry-based methods for SNP genotyping: Bocker, "SNP and mutation discovery using base-specific cleavage and MALDI-TOF mass spectrometry", Bioinformatics. 2003 July; 19 Suppl 1:144-153; Storm et al., "MALDI-TOF mass spectrometry-based SNP genotyping", *Methods Mol Biol.* 2003; 212:241-62; Jurinke et al., "The use of Mass ARRAY technology for high throughput genotyping", *Adv Biochem Eng Biotechnol.* 2002; 77:57-74; and Jurinke et al., "Automated genotyping using the DNA MassArray technology", *Methods Mol Biol.* 2002; 187:179-92.

SNPs can also be scored by direct DNA sequencing. A variety of automated sequencing procedures can be utilized ((1995) *Biotechniques* 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730×l DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W.H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (Genetic Data Analysis, Weir B., Sinauer (1990)).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $R^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score". In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the p-value of the tests reaches that level. In an exploratory analysis where positive hits will be followed up in subsequent confirmatory testing, an unadjusted p-value<0.2 (a significance level on the lenient side), for example, may be used for generating hypotheses for significant association of a SNP with certain phenotypic characteristics of a disease. It is preferred that a p-value<0.05 (a significance level traditionally used in the art) is achieved in order for a SNP to be considered to have an association with a disease. It is more preferred that a p-value<0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wise error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (*The Elements of Statistical Learning*, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the susceptibility allele(s).

The SNPs of the invention may contribute to liver fibrosis and related pathologies in an individual in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose", "diagnosis", and "diagnostics" include, but are not limited to any of the following: detection of liver fibrosis that an individual may presently have, predisposition/susceptibility screening (i.e., determining the increased risk of an individual in developing liver fibrosis in the future, or determining whether an individual has a decreased risk of developing liver fibrosis in the future, determining the rate of progression of fibrosis to bridging fibrosis/cirrhosis), determining a particular type or subclass of liver fibrosis in an individual known to have liver fibrosis, confirming or reinforcing a previously made diagnosis of liver fibrosis, pharmacogenomic evaluation of an individual to determine which therapeutic strategy that individual is most likely to positively respond to or to predict whether a patient is likely to respond to a particular treatment, predicting whether a patient is likely to experience toxic effects from a particular treatment or therapeutic compound, and evaluating the future prognosis of an individual having liver fibrosis. Such diagnostic uses are based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium". In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for diagnosing liver fibrosis and related pathologies (e.g., has a significant statistical association with the condition and/or is recognized as a causative polymorphism for the condition), then the skilled artisan would recognize that other SNP sites which are in LD with this SNP site would also be useful for diagnosing the condition. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., liver fibrosis) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include, for example, other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1-2, for example.

Linkage disequilibrium in the human genome is reviewed in: Wall et al., "Haplotype blocks and linkage disequilibrium in the human genome", *Nat Rev Genet.* 2003 August; 4(8):587-97; Garner et al., "On selecting markers for association studies: patterns of linkage disequilibrium between two and three diallelic loci", Genet Epidemiol. 2003 January; 24(1):57-67; Ardlie et al., "Patterns of linkage disequilibrium in the human genome", *Nat Rev Genet.* 2002 April; 3(4):299-309 (erratum in *Nat Rev Genet* 2002 July; 3(7): 566); and Remm et al., "High-density genotyping and linkage disequilibrium in the human genome using chromosome 22 as a model"; *Curr Opin Chem Biol.* 2002 February; 6(1):24-30.

The contribution or association of particular SNPs and/or SNP haplotypes with disease phenotypes, such as liver fibrosis, enables the SNPs of the present invention to be used to develop superior diagnostic tests capable of identifying individuals who express a detectable trait, such as liver fibrosis, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with liver fibrosis might indicate a probability of 20% that an individual has or is at risk of developing liver fibrosis, whereas detection of five SNPs, each of which correlates with liver fibrosis, might indicate a probability of 80% that an individual has or is at risk of developing liver fibrosis. To further increase the accuracy of diagnosis or predisposition screening, analysis of the SNPs of the present invention can be combined with that of other polymorphisms or other risk factors of liver fibrosis, such as disease symptoms, pathological characteristics, family history, diet, environmental factors or lifestyle factors.

It will, of course, be understood by practitioners skilled in the treatment or diagnosis of liver fibrosis that the present invention generally does not intend to provide an absolute identification of individuals who are at risk (or less at risk) of developing liver fibrosis, and/or pathologies related to liver fibrosis, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to liver fibrosis.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211(2001); Eichelbaum, *Clin. Exp. Pharmacol. Physiol.* 23(10-11):983-985 (1996); and Linder, *Clin. Chem.* 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating liver fibrosis. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms", *Methods Mol Med*. 2003; 85:225-37. Pharmacogenomics as it relates to Alzheimer's disease and other neurodegenerative disorders is discussed in Cacabelos, "Pharmacogenomics for the treatment of dementia", *Ann Med*. 2002; 34(5):357-79, Maimone et al., "Pharmacogenomics of neurodegenerative diseases", *Eur J Pharmacol*. 2001 Feb. 9; 413(1):11-29, and Poirier, "Apolipoprotein E: a pharmacogenetic target for the treatment of Alzheimer's disease", *Mol Diagn*. 1999 December; 4(4):335-41. Pharmacogenomics as it relates to cardiovascular disorders is discussed in Siest et al., "Pharmacogenomics of drugs affecting the cardiovascular system", *Clin Chem Lab Med*. 2003 April; 41(4):590-9, Mukherjee et al., "Pharmacogenomics in cardiovascular diseases", *Prog Cardiovasc Dis*. 2002 May-June; 44(6):479-98, and Mooser et al., "Cardiovascular pharmacogenetics in the SNP era", *J Thromb Haemost*. 2003 July; 1(7):1398-402. Pharmacogenomics as it relates to cancer is discussed in McLeod et al., "Cancer pharmacogenomics: SNPs, chips, and the individual patient", *Cancer Invest*. 2003; 21(4):630-40 and Watters et al., "Cancer pharmacogenomics: current and future applications", *Biochim Biophys Acta*. 2003 Mar. 17; 1603(2):99-111.

The SNPs of the present invention also can be used to identify novel therapeutic targets for liver fibrosis. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Lavery et al., "Antisense and RNAi: powerful tools in drug target discovery and validation", *Curr Opin Drug Discov Devel*. 2003 July; 6(4):561-9; Stephens et al., "Antisense oligonucleotide therapy in cancer", *Curr Opin Mol Ther*. 2003 April; 5(2): 118-22; Kurreck, "Antisense technologies. Improvement through novel chemical modifications", *Eur J Biochem*. 2003 April; 270(8):1628-44; Dias et al., "Antisense oligonucleotides: basic concepts and mechanisms", *Mol Cancer Ther*. 2002 March; 1(5):347-55; Chen, "Clinical development of antisense oligonucleotides as anti-cancer therapeutics", Methods *Mol Med*. 2003; 75:621-36; Wang et al., "Antisense anticancer oligonucleotide therapeutics", *Curr Cancer Drug Targets*. 2001 November; 1(3):177-96; and Bennett, "Efficiency of antisense oligonucleotide drug discovery", *Antisense Nucleic Acid Drug Dev*. 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as liver fibrosis, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs (Thompson, *Drug Discovery Today,* 7 (17): 912-917 (2002)). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference", *Nat Biotechnol.* 2004 March; 22(3):326-30. Epub 2004 Feb. 1; Chi et al., "Genomewide view of gene silencing by small interfering RNAs", *PNAS* 100(11):6343-6346, 2003; Vickers et al., "Efficient Reduction of Target RNAs by Small Interfering RNA and RNase H-dependent Antisense Agents", *J. Biol. Chem.* 278: 7108-7118, 2003; Agami, "RNAi and related mechanisms and their potential use for therapy", *Curr Opin Chem Biol.* 2002 December; 6(6):829-34; Lavery et al., "Antisense and RNAi: powerful tools in drug target discovery and validation", *Curr Opin Drug Discov Devel.* 2003 July; 6(4):561-9; Shi, "Mammalian RNAi for the masses", *Trends Genet* 2003 January; 19(1):9-12), Shuey et al., "RNAi: gene-silencing in therapeutic intervention", *Drug Discovery Today* 2002 October; 7(20):1040-1046; McManus et al., *Nat Rev Genet* 2002 October; 3(10):737-47; Xia et al., *Nat Biotechnol* 2002 October; 20(10):1006-10; Plasterk et al., *Curr Opin Genet Dev* 2000 October; 10(5):562-7; Bosher et al., *Nat Cell Biol* 2000 February; 2(2):E31-6; and Hunter, *Curr Biol* 1999 Jun. 17; 9(12):R440-2).

A subject suffering from a pathological condition, such as liver fibrosis, ascribed to a SNP may be treated so as to correct the genetic defect (see Kren et al., *Proc. Natl. Acad. Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat liver fibrosis. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a liver fibrosis patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as liver fibrosis that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For instance, an aspect of the present invention includes selecting individuals for clinical trials based on their SNP genotype. For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular liver fibrosis patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine*, 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine*, 2002 March; S30-S36).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the liver fibrosis-associated proteins, and encoding nucleic acid molecules, disclosed herein can be used as therapeutic targets (or directly used themselves as therapeutic compounds) for treating liver fibrosis and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semisolid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, $18^{th}$ ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of a liver fibrosis-associated protein can be administered in combination with another agent that inhibits or stimulates the activity of the same or a different liver fibrosis-associated protein to thereby counteract the affects of liver fibrosis.

For further information regarding pharmacology, see *Current Protocols in Pharmacology*, John Wiley & Sons, Inc., N.Y.

Human Identification Applications

In addition to their diagnostic and therapeutic uses in liver fibrosis and related pathologies, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med.* 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry", *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artefacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June; 20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, *Stanford Technology Law Review* and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found in, for example, *Current Protocols in Human Genetics*, John Wiley & Sons, N.Y. (2002), 14.1-14.7.

Variant Proteins, Antibodies,
Vectors & Host Cells, & Uses Thereof
Variant Proteins Encoded by SNP-Containing Nucleic Acid Molecules The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are provided as SEQ ID NOS:262-522 in Table 1 and the Sequence Listing. These variants will generally be referred to herein as variant proteins/peptides/polypeptides, or polymorphic proteins/peptides/polypeptides of the present invention. The terms "protein", "peptide", and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons which contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e g, mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol.* 2003 January; 60(5):523-33. Epub 2002 Nov. 7; Graddis et al., "Designing proteins that work using recombinant technologies", *Curr Pharm Biotechnol.* 2002 December; 3(4): 285-97; and Nilsson et al., "Affinity fusion strategies for detection, purification, and immobilization of recombinant proteins", *Protein Expr Purif.* 1997 October; 11(1):1-16.

The present invention also relates to further obvious variants of the variant polypeptides of the present invention, such as naturally-occurring mature forms (e.g., alleleic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Be; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., *Science* 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol.* 224:899-904 (1992); de Vos et al. *Science* 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties*, 2nd Ed., T. E. Creighton, W. H. Freeman and Company, New York (1993); Wold, F., *Posttranslational Covalent Modification of Proteins*, B. C. Johnson, Ed., Academic Press, New York 1-12 (1983); Seifter et al., *Meth. Enzymol.* 182: 626-646 (1990); and Rattan et al., *Ann. N.Y. Acad. Sci.* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS: 262-522. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing liver fibrosis or for determining predisposition to liver fibrosis in a human. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with liver fibrosis that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun. 15; 71(12):294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82-84 (1991); Houghten et al., Nature 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, Bio/technology, 1992, Sep. 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as liver fibrosis. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) Oncogene 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc. Natl. Acad. Sci. USA,* 81:6851, 1984; Neuberger et al., *Nature* 312:604, 1984), a humanized antibody (U.S. Pat. Nos. 5,693,762; 5,585,089; and 5,565,332), a single-chain Fv (U.S. Pat. No. 4,946,778; Ward et al., *Nature* 334:544, 1989), a bispecific antibody with two binding specificities (Segal et al., *J. Immunol. Methods* 248:1, 2001; Carter, *J. Immunol.* Methods 248:7, 2001), a diabody, a triabody, and a tetrabody (Todorovska et al., *J. Immunol. Methods,* 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, *Nature,* 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., *J. Immunol.,* 169:595, 2002). Fd phage and Fd phagemid technologies may be used to generate and select recombinant antibodies in vitro (Hoogenboom and Chames, *Immunol. Today* 21:371, 2000; Liu et al., *J. Mol. Biol.* 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^3$H.

Antibodies, particularly the use of antibodies as therapeutic agents, are reviewed in: Morgan, "Antibody therapy for Alzheimer's disease", *Expert Rev Vaccines.* 2003 February; 2(1):53-9; Ross et al., "Anticancer antibodies", *Am J Clin Pathol.* 2003 April; 119(4):472-85; Goldenberg, "Advancing role of radiolabeled antibodies in the therapy of cancer", *Cancer Immunol Immunother.* 2003 May; 52(5):281-96. Epub 2003 Mar. 11; Ross et al., "Antibody-based therapeutics in oncology", *Expert Rev Anticancer Ther.* 2003 February; 3(1):107-21; Cao et al., "Bispecific antibody conjugates in therapeutics", *Adv Drug Deliv Rev.* 2003 Feb. 10; 55(2):171-97; von Mehren et al., "Monoclonal antibody therapy for cancer", *Annu Rev Med.* 2003; 54:343-69. Epub 2001 Dec. 3; Hudson et al., "Engineered antibodies", *Nat Med.* 2003 January; 9(1):129-34; Brekke et al., "Therapeutic antibodies for human diseases at the dawn of the twenty-first century", *Nat Rev Drug Discov.* 2003 January; 2(1):52-62 (Erratum in: *Nat Rev Drug Discov.* 2003 March; 2(3):240); Houdebine, "Antibody manufacture in transgenic animals and comparisons with other systems", *Curr Opin Biotechnol.* 2002 December; 13(6):625-9; Andreakos et al., "Monoclonal antibodies in immune and inflammatory diseases", *Curr Opin Biotechnol.* 2002 December; 13(6):615-20; Kellermann et al., "Antibody discovery: the use of transgenic mice to generate human monoclonal antibodies for therapeutics", *Curr Opin Biotechnol.* 2002 December; 13(6):593-7; Pini et al., "Phage display and colony filter screening for high-throughput selection of antibody libraries", *Comb Chem High Throughput Screen.* 2002 November; 5(7):503-10; Batra et al., "Pharmacokinetics and biodistribution of genetically engineered antibodies", *Curr Opin Biotechnol.* 2002 December; 13(6):603-8; and Tangri et al., "Rationally engineered proteins or antibodies with absent or reduced immunogenicity", *Curr Med Chem.* 2002 December; 9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as liver fibrosis. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, particularly liver fibrosis. Antibodies specific for a variant protein encoded by a SNP-containing nucleic acid molecule of the present invention can be used to assay for the presence of the variant protein, such as to screen for predisposition to liver fibrosis as indicated by the presence of the variant protein. Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., *Cytokine* 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli*, *Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kurjan et al., *Cell* 30:933-943(1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (Seed, B. *Nature* 329:840(1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al. *PNAS* 89:6232-6236 (1992)). Another example of a recombinase system is the FLP recombinase system of *S. cerevisiae* (O'Gorman et al. *Science* 251:1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems", *Curr Opin Biotechnol.* 2002 December; 13(6):625-9; Petters et al., "Transgenic animals as models for human disease", *Transgenic Res.* 2000; 9(4-5):347-51; discussion 345-6; Wolf et al., "Use of transgenic animals in understanding molecular mechanisms of toxicity", *J Pharm Pharmacol.* 1998 June; 50(6):567-74; Echelard, "Recombinant protein production in transgenic animals", *Curr Opin Biotechnol.* 1996 October; 7(5):536-40; Houdebine, "Transgenic animal bioreactors", *Transgenic Res.* 2000; 9(4-5):305-20; Pirity et al., "Embryonic stem cells, creating transgenic animals", *Methods Cell Biol.* 1998; 57:279-93; and Robl et al., "Artificial chromosome vectors and expression of complex proteins in transgenic animals", *Theriogenology.* 2003 Jan. 1; 59(1):107-13.

Computer-Related Embodiments

The SNPs provided in the present invention may be "provided" in a variety of mediums to facilitate use thereof. As used in this section, "provided" refers to a manufacture, other than an isolated nucleic acid molecule, that contains SNP information of the present invention. Such a manufacture provides the SNP information in a form that allows a skilled artisan to examine the manufacture using means not directly applicable to examining the SNPs or a subset thereof as they exist in nature or in purified form. The SNP information that may be provided in such a form includes any of the SNP information provided by the present invention such as, for example, polymorphic nucleic acid and/or amino acid sequence information such as SEQ ID NOS:1-261, SEQ ID NOS:262-522, SEQ ID NOS:4999-5321, SEQ ID NOS:523-4998, and SEQ ID NOS:5322-34256; information about observed SNP alleles, alternative codons, populations, allele frequencies, SNP types, and/or affected proteins; or any other information provided by the present invention in Tables 1-2 and/or the Sequence Listing.

In one application of this embodiment, the SNPs of the present invention can be recorded on a computer readable medium. As used herein, "computer readable medium" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising computer readable medium having recorded thereon a nucleotide sequence of the present invention. One such medium is provided with the present application, namely, the present application contains computer readable medium (CD-R) that has nucleic acid sequences (and encoded protein sequences) containing SNPs provided/recorded thereon in ASCII text format in a Sequence Listing along with accompanying Tables that contain detailed SNP and sequence information (transcript sequences are provided as SEQ ID NOS:1-261, protein sequences are provided as SEQ ID NOS:262-522, genomic sequences are provided as SEQ ID NOS:4999-5321, transcript-based context sequences are provided as SEQ ID NOS:523-4998, and genomic-based context sequences are provided as SEQ ID NOS:5322-34256).

As used herein, "recorded" refers to a process for storing information on computer readable medium. A skilled artisan can readily adopt any of the presently known methods for recording information on computer readable medium to generate manufactures comprising the SNP information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide/amino acid sequence information of the present invention on computer readable medium. For example, the sequence information can be represented in a word processing text file, formatted in commercially-available software such as WordPerfect and Microsoft Word, represented in the form of an ASCII file, or stored in a database application, such as OB2, Sybase, Oracle, or the like. A skilled artisan can readily adapt any number of data processor structuring formats (e.g., text file or database) in order to obtain computer readable medium having recorded thereon the SNP information of the present invention.

By providing the SNPs of the present invention in computer readable form, a skilled artisan can routinely access the SNP information for a variety of purposes. Computer software is publicly available which allows a skilled artisan to access sequence information provided in a computer readable medium. Examples of publicly available computer software include BLAST (Altschul et al., *J. Mol. Biol.* 215:403-410 (1990)) and BLAZE (Brutlag et al., *Comp. Chem.* 17:203-207 (1993)) search algorithms.

The present invention further provides systems, particularly computer-based systems, which contain the SNP information described herein. Such systems may be designed to store and/or analyze information on, for example, a large number of SNP positions, or information on SNP genotypes from a large number of individuals. The SNP information of the present invention represents a valuable information source. The SNP information of the present invention stored/analyzed in a computer-based system may be used for such computer-intensive applications as determining or analyzing SNP allele frequencies in a population, mapping disease genes, genotype-phenotype association studies, grouping SNPs into haplotypes, correlating SNP haplotypes with response to particular drugs, or for various other bioinformatic, pharmacogenomic, drug development, or human identification/forensic applications.

As used herein, "a computer-based system" refers to the hardware means, software means, and data storage means used to analyze the SNP information of the present invention. The minimum hardware means of the computer-based systems of the present invention typically comprises a central processing unit (CPU), input means, output means, and data storage means. A skilled artisan can readily appreciate that any one of the currently available computer-based systems are suitable for use in the present invention. Such a system can be changed into a system of the present invention by utilizing the SNP information provided on the CD-R, or a subset thereof, without any experimentation.

As stated above, the computer-based systems of the present invention comprise a data storage means having stored therein SNPs of the present invention and the necessary hardware means and software means for supporting and implementing a search means. As used herein, "data storage means" refers to memory which can store SNP information of the present invention, or a memory access means which can access manufactures having recorded thereon the SNP information of the present invention.

As used herein, "search means" refers to one or more programs or algorithms that are implemented on the computer-based system to identify or analyze SNPs in a target sequence based on the SNP information stored within the data storage means. Search means can be used to determine which nucleotide is present at a particular SNP position in the target sequence. As used herein, a "target sequence" can be any DNA sequence containing the SNP position(s) to be searched or queried.

As used herein, "a target structural motif," or "target motif," refers to any rationally selected sequence or combination of sequences containing a SNP position in which the sequence(s) is chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, hairpin structures, and inducible expression elements (protein binding sequences).

A variety of structural formats for the input and output means can be used to input and output the information in the computer-based systems of the present invention. An exemplary format for an output means is a display that depicts the presence or absence of specified nucleotides (alleles) at particular SNP positions of interest. Such presentation can provide a rapid, binary scoring system for many SNPs simultaneously.

One exemplary embodiment of a computer-based system comprising SNP information of the present invention is provided in FIG. 1. FIG. 1 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable storage medium 116 once inserted in the removable medium storage device 114.

The SNP information of the present invention may be stored in a well-known manner in the main memory 108, any of the secondary storage devices 110, and/or a removable storage medium 116. Software for accessing and processing the SNP information (such as SNP scoring tools, search tools, comparing tools, etc.) preferably resides in main memory 108 during execution.

EXAMPLES

The following examples are offered to illustrate, but not to limit the claimed invention.

Statistical Analysis of SNP Association with Liver Fibrosis in HCV-Infected Individuals Example 1

A case-control genetic study was performed to determine the association of SNPs in the human genome with liver fibrosis and in particular the increased or decreased risk of developing bridging fibrosis/cirrhosis, and the rate of progression of fibrosis in HCV infected patients. The study involved genotyping SNPs in DNA samples obtained from >500 HCV-infected patients. The study population came from 2 clinic sites, the University of California, San Francisco (UCSF) and Stanford University (Stanford). Among the 435 patients from UCSF, the percentage for minimal, moderate, and severe fibrosis was 46%, 26%, and 28%, respectively, which reflects the distribution of HCV patients in their clinics. The 100 samples obtained from Stanford were intentionally collected on extreme cases, and therefore comprised 62% minimal fibrosers and 38% severe fibrosers. Samples were divided into a case group or a control group. The cases comprised those samples obtained from individuals determined to have severe fibrosis (bridging fibrosis/cirrhosis) and the controls comprised those samples obtained from individuals with minimal and moderate fibrosis. The stage of fibrosis in each individual was determined according to the system of Batts et al., *Am. J. Surg. Pathol.* 19:1409-1417 (1995) as reviewed by Brunt *Hepatology* 31:241-246 (2000). All patients who donated samples had signed informed, written consent, and the study protocols were approved by the respective Institutional Review Boards (IRB).

DNA was extracted from individual blood samples using conventional DNA extraction methods or by using commercially available kits according to manufacturer's suggested conditions, such as the QIA-amp kit from Qiagen (Valencia, Calif.). SNP markers in the extracted DNA samples were analyzed by genotyping using primers such as those presented in Table 5. While some samples were individually genotyped, the same samples and any remaining samples were also used for pooling studies, in which DNA samples from about 50 individuals were pooled and allele frequencies were obtained using a PRISM® 7900 HT Sequence Detection System (Applied Biosystems, Foster City, Calif.) by kinetic allele-specific PCR similar to the method described by Germer et al., *Genome Research* 10:258-266 (2000).

The results of statistical analysis of association of a SNP with a decreased risk of developing bridging fibrosis/cirrhosis are presented in Table 6. For statistical analysis, the outcomes include only fibrosis stage (categorized into 0+1, 2, for controls and 3+4 for cases) (and identified as "stage" in Table 6). Genotypes were categorized into ordinal (three groups, including major homozygotes, heterozygotes, and minor homozygotes) as well as using a dominant model assumption (two groups, including major homozygotes versus heterozygotes+minor homozygotes). Multiple logistic regression as well as proportional logistic regression analysis was used to generate age-adjusted odds ratios and 95% confidence intervals to assess the association between the genotypes and fibrosis stage. All reported p-values are two-sided.

A marker having an odds ratio (OR)<1.0 is protective (e.g., an individual is less likely to develop severe liver fibrosis), whereas a marker having an odds ratio (OR)>1.0 is associated with an increased risk (e.g., an individual is more likely to develop severe liver fibrosis).

Among the 120 SNPs tested in the two sample sets, hCV11638783 is a marker that is associated with decreased risk for severe fibrosis. hCV11638783 is a replicated marker because it shows significant association with severe fibrosis in both the UCSF and Stanford sample sets (p-values of 0.0014 and 0.0175 respectively in the ordinal analyses and 0.0055 and 0.0071 respectively in the dominant analyses). The odds ratio in both sample sets was less than 1.0 (in the UCSF sample set, for ordinal, the odds ratio was 0.583 for fibrosis stage, and, for dominant, the odds ratio was 0.586 for fibrosis stage. In the Stanford sample set, for ordinal, the odds ratio was 0.408 for fibrosis stage; in "Sample Set 2", for dominant, the odds ratio was 0.291 for fibrosis stage). Thus, this SNP may be used to identify individuals with a decreased risk of developing fibrosis, especially bridging fibrosis/cirrhosis.

Example 2

Sample Set Description

In a second case control study, DNA samples obtained from the University of California San Francisco (UCSF) were used as a discovery sample set to initially identify SNPs in association with severe fibrosis. Among the 537 patients in the discovery sample set, the percentage for minimal stage 0-1, moderate stage 2, and severe stage 3-4 fibrosers was 52%, 23%, and 25%, respectively, which reflects the typical distribution of HCV infected patients in clinics.

In addition sample sets were collected from 3 additional but different clinic sites for use in replication studies: Virginia Commonwealth University (VCU), University of Illinois, Chicago (UIC) and Stanford University (Stanford). Among the approximately 483 patients in the sample set from VCU, the percentage for minimal, moderate, and severe fibrosis was approximately 18%, 34%, and 48%, respectively. Among the 115 patients in the sample set from UIC, the percentage for minimal, moderate, and severe fibrosis was 29%, 30%, and 41%, respectively. Samples from the Stanford sample set were intentionally collected on extreme cases, which contained 62% minimal stage 0-1 fibrosers and 38% severe stage 3-4 fibrosers. The stage of fibrosis in each individual in the VCU sample set was determined according to the system of Knodell et al., Hepatology 1:431-435 (1981). The stage of fibrosis in individuals in the UCSF, UIC and Stanford sample sets was determined according to the system of Batts et al., Am J. Surg. Pathol. 19:1409-1417 (1995). Both scoring systems are reviewed by Brunt Hepatology 31:241-246 (2000). All patients who donated samples had signed informed, written consent, and the study protocols were approved by their respective IRBs.

All patients in the sample sets met the inclusion/exclusion criteria in the study protocol as follows:

Inclusion Criteria:
Adults (Age 18~75).
HCV positive patients who have undergone a full course (at least 24 weeks) of Interferon (IFN) treatment (any formulation+/−ribavirin) and for whom six month follow-up viral load data was available/potentially available.

Exclusion Criteria:
Discontinuation of IFN treatment secondary to poor tolerance of side effects
Evidence of other chronic active viral hepatitis including positive hepatitis antigen,
Evidence of co-infection with human immunodeficiency virus (HIV), e.g. Positive anti-HIV antibody.
Evidence of other serious liver disease: e.g. Wilson's Hemachromatosis, etc
Other serious medical conditions: Rheumatic/renal/lung diseases, cardiovascular disease, cancer
Additional Information Used for Data Analysis:
Age
Race
Gender
HCV genotype
Viral load
Ethanol use
Intravenous drug use
Other medications
Exact treatment regimen
Alanine amino transferase levels
Response to IFN treatment
Other medical history, including serious medical illness such as kidney disease, cardiovascular disease, autoimmune disease, and cancer Pooling and Whole Genome Scan on Discovery Sample Set Association of SNP alleles in the human genome with fibrosis stage in HCV patients was tested in the discovery sample set. DNA was extracted from blood samples using a standard protocol or DNA extraction kits as described above. DNA samples from patients were pooled based on similar clinical phenotypes of the patients. While some samples were individually genotyped, the same samples were also used for pooling studies, in which DNA samples from about 50 individuals were pooled and allele frequencies in the pools were obtained using primers such as those presented in Table 5. Genotypes and pool allele frequencies were measured using a PRISM® 7900HT Sequence Detection PCR System (Applied Biosystems) by kinetic allele-specific PCR, similar to the method described by Germer et al. (Germer S., Holland M. J., Higuchi R. 2000, Genome Res. 10: 258-266).

Data Analysis on Whole Genome Scan Using Pooled DNA

Approximately 21,470 SNPs throughout the genome were genotyped in the discovery sample set. Allele odds ratios and p-values were generated comparing the advanced or high fibrosis stage group (case group) (also known as bridging fibrosis/cirrhosis) vs. medium and low groups (mild or no fibrosis) (control group). Results were stratified by ethnicity (all ethnic groups (A) Caucasian (C) and other than Caucasian (0)) for the stage outcome to assess any confounding by these factors.

Data Analysis of Individual Genotyping Results on Replication Sample Sets

About 175 SNPs were selected from a study using the discovery sample set based on their association with severe fibrosis. These SNPs were then retested by individual genotyping in the UCSF sample set to confirm the initial results and in the VCU, UIC or Stanford sample sets. The data obtained from the VCU sample set was used to replicate the results obtained from the UCSF sample set. The UIC and Stanford sample sets provided additional replication data. The Allelic Association, Fischer Exact Test was used to analyze the association of a SNP with fibrosis stage. In replication studies, a SNP was considered a replicated marker only if it had a significant p-value<0.1 for a particular stage in the UCSF sample set and the VCU sample set, and the Odds Ratio (OR) had to go in the same direction—that is, the regression coefficient had to have the same sign in each of the UCSF and VCU sample sets. 67 markers were replicated in these two sample sets in showing statistically significant association with severe fibrosis (Table 7). For example, marker hCV7450990 is a replicated marker when all patients as well as patients other than Caucasian populations (but not the Caucasian only population were analyzed, whereas marker hCV11935588, is a replicated marker when all patients as well as Caucasian-only population were analyzed. Both of these SNPs are protective alleles with ORs<1.

hCV7450990 a missense SNP in DDX5, which encodes a DEAD (Asp-Glu-Ala-Asp) box polypeptide 5, and it is shown to have an association with severe fibrosis in both the UCSF and VCU sample sets. Previous studies in the art have shown that this gene is expressed in multiple tissues including the liver. A recent report indicates that DDX5, an RNA helicase also known as p68, interacts with HCV NS5B (HCV RNA-dependent RNA polymerase), suggesting that DDX5 is a human cellular factor involved in HCV RNA replication (Goh et al., *J Virol.*, 2004, 78: 5288-98). Therefore, SNPs in the DDX5 gene, particularly missense SNPs such as hCV7450990, might render a protective effect by affecting the ability of HCV to replicate.

SNP (hCV11935588), which is located in a gene on chromosome 16, is an example of a marker associated with severe fibrosis in Caucasians in all four sample sets.

In addition, hCV15851335 also showed association with severe fibrosis when all patients as well as a Caucasian-only population were analyzed in the UCSF and VCU sample sets (Table 7). hCV15851335 is a missense SNP in CPT1A (carnitine palmitoyltransferase 1A, liver). CPTIA is a key enzyme in carnitine-dependent transport across the mitochondrial inner membrane, and its deficiency results in a decreased rate of fatty acid beta-oxidation, which causes fatty liver diseases.

The SNPs disclosed herein could be used to identify other markers that are associated with and increased risk of developing bridging fibrosis/cirrhosis, and progression of fibrosis in HCV-infected individuals and other liver disease patients. For example, the markers listed in Tables 6-7 can be used to identify other mutations (preferably SNPs), such as those that exhibit similar or enhanced predictive value, in the identified genes or surrounding nucleotide sequence (e.g., 500 Kb upstream to 500 Kb downstream of the marker) through database searches or through sequencing of DNA samples. Specifically, marker hCV7450990 is an A480S change in DDX5, a DEAD-Box RNA helicase. DEAD-Box proteins are characterized by an Asp-Glu-Ala-Asp motif. DDX5 is located on the long arm of chromosome 17, 17q24.1. The sex-averaged recombination rate in the region is estimated to be 0.6 cM/Mb. The SNP appears to fall within a region of high linkage disequilibrium that extends roughly 20 Kb centromeric of the SNP and extends roughly 244 Kb telomeric to the SNP. Other SNPs in these two regions may be associated with fibrosis progression rate or inflammation. Given the high homology within the DEAD-Box protein family, all DEAD-box genes and SNPs in those genes are likely to play a role in advanced fibrosis stage.

Marker hCV11935588 is located in a gene on chromosome 16. The following genes are located in the region and may also play a role in advanced fibrosis stage: 1) CTRB1 (chymotrypsinogen B1) is located within roughly 10 kb of marker hCV11935588. CTRB1 is a zymogen secreted by the pancreas (highly expressed in the pancreas) and cleaved by trypsin to become a protease in the small intestine. It is also expressed in the liver. 2) BCAR1 (breast cancer antiestrogen resistance) is within 50 kb of marker hCV11935588 and is involved in apoptosis. 3) LDHD (lactate dehydrogenase D) is roughly 100 kb away from marker hCV11935588. LDHD is in the electron transport chain and highly expressed in the liver. It's also expressed in the kidneys. Two isoforms of LDHD exist. 4) KARS (lysyl-tRNA synthetase) is within 400 kb of marker hCV11935588. KARS is expressed in many immune cells (NK, T-cells, B cells, etc.), and is also expressed in BM tissue. A p-value of 0.01 was observed in Sample Set 1 at a SNP in the KARS gene. KARS has been shown to play a role in autoimmune diseases and is a target for autoantibodies in polymyositis and dermatomyositis.

The SNPs disclosed herein, alone, or in combination with other risk factors, such as age, gender, and alcohol consumption, can provide a non-invasive test that enables physicians to assess the fibrosis risk in HCV-infected individuals. Such a test offers several advantages, such as: 1) enabling better treatment strategies (for example, individuals with a higher fibrosis risk can be given higher priority for treatment, while treatment for individuals with a lower fibrosis risk can be delayed, thereby alleviating them from the side effects and high cost of treatment); and 2) reducing the need for repeated liver biopsies for all patients.

Furthermore, the SNPs disclosed herein could be used in diagnostic kits to assess the increased or decreased risk of developing bridging fibrosis/cirrhosis and progression of fibrosis for patients with other liver diseases, such as hepatitis B, any co-infection with other viruses (such as HIV, etc.), non-alcoholic fatty liver diseases (NAFLD), drug-induced liver diseases, alcoholic liver diseases (ALD), primary biliary cirrhosis (PBC), primary sclerosing cholangitis (PSC), autoimmune hepatitis (AIH) and cryptogenic cirrhosis. Depending on the genotypes of one or multiple markers disclosed in any of Tables 6-7, alone or in combination with other risk factors, physicians could categorize these patients into slow, median, or rapid fibrosers.

All publications and patents cited in this specification are herein incorporated by reference in their entirety. Various modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 5

| Marker | Alleles | Sequence A (allele-specific primer) |
|---|---|---|
| hCV11176855 | C/T | TCAGTTCCCAATTCTATATGTCTC (SEQ ID NO: 34257) |
| hCV11291454 | A/G | AAACCAGCCAAATTCCTTC (SEQ ID NO: 34260) |
| hCV11486078 | C/G | AGCCCCAGAACCTGC (SEQ ID NO: 34263) |
| hCV11611200 | A/G | CGGGATTTCAGGTGTGAGT (SEQ ID NO: 34266) |
| hCV11611201 | A/G | CTTCCTGAGAAGTCAAGAAGT (SEQ ID NO: 34269) |
| hCV11638783 | A/G | AAGGGCTTCGGGGTAC (SEQ ID NO: 34272) |
| hCV11722237 | C/T | CAAAGTGATTTGGGACAAC (SEQ ID NO: 34275) |
| hCV11743295 | A/G | CATCATTTCCTTACAATACTGTCT (SEQ ID NO: 34278) |

TABLE 5-continued

| | |
|---|---|
| hCV11745746 C/G | GGGAGGTTATTGTGAACTAGG (SEQ ID NO: 34281) |
| hCV11749854 C/G | GCTCATCTGCATCCGC (SEQ ID NO: 34284) |
| hCV11894038 A/G | CTTATGAAAGATTTCAAATCCTCTA (SEQ ID NO: 34287) |
| hCV11935588 A/T | ATTTCTGCCTGGTCTGTGT (SEQ ID NO: 34290) |
| hCV11944682 C/T | TGAAAACATTTAAAGTTTCCTCAC (SEQ ID NO: 34293) |
| hCV11955739 A/G | CACTACCTCCCTCTAGGAGAAA (SEQ ID NO: 34296) |
| hCV1198609 G/T | AGTTAAATGAATACACTGATGGAC (SEQ ID NO: 34299) |
| hCV11986235 G/T | GCCACTGGCCATCACT (SEQ ID NO: 34302) |
| hCV1259266 C/T | GCTTAAGAGCAACCTCAGAGAC (SEQ ID NO: 34305) |
| hCV1283127 C/G | CAGGCATGACATTGAAAC (SEQ ID NO: 34308) |
| hCV1478583 A/G | AGGTAGGTACCCGTGTTTACA (SEQ ID NO: 34311) |
| hCV15851335 C/T | GATGGCATGGATGGC (SEQ ID NO: 34314) |
| hCV15853499 C/T | GCAGTCATGGAGAGCATG (SEQ ID NO: 34317) |
| hCV15964790 G/T | GCAGTATCTCTCTCCATCCC (SEQ ID NO: 34320) |
| hCV16166459 C/T | GTCAGAATTTCATTTACTAGAATCCAC (SEQ ID NO: 34323) |
| hCV16167920 C/T | GAGATTACAAAGGGTCCAGTA (SEQ ID NO: 34326) |
| hCV1728296 A/G | CTATGGTAGGTGCTGAGAATATATA (SEQ ID NO: 34329) |
| hCV1801154 A/G | TCCTCTTTTACTTCTTTCCTGA (SEQ ID NO: 34332) |
| hCV1895513 C/T | ACTTGAATAAAGCTGTATGACCTAC (SEQ ID NO: 34335) |
| hCV192738 C/G | TGCCCGTGGTCAGC (SEQ ID NO: 34338) |
| hCV22271827 C/T | GATGTTTTCTTGAATACACC (SEQ ID NO: 34341) |
| hCV22272667 C/T | CAGGCAAAAAGTCTTGAAT (SEQ ID NO: 34344) |
| hCV22272823 G/T | GCGCTGGTGAGACCCT (SEQ ID NO: 34347) |
| hCV22274307 C/T | GACCTACGCTCCTTCATCTAAC (SEQ ID NO: 34350) |
| hCV22274712 C/G | CTTACAGAAGGACATCCTTTACAG (SEQ ID NO: 34353) |
| hCV2231920 A/G | CACTCCAGCACATAGAGGAT (SEQ ID NO: 34356) |
| hCV2231945 C/T | GCCTGCTCCCTCATCC (SEQ ID NO: 34359) |
| hCV2351160 A/G | CCACCAGTGGCTATCA (SEQ ID NO: 34362) |
| hCV2384392 C/T | AAATGCTAGCAGCCCC (SEQ ID NO: 34365) |
| hCV2479345 C/G | CTCCTGAAAGGGTTGAACTC (SEQ ID NO: 34368) |
| hCV25600642 C/G | CGCGGCCGAAGC (SEQ ID NO: 34371) |
| hCV25609481 A/G | CTGCTGAGGCAATTAACTAAATA (SEQ ID NO: 34374) |
| hCV25639661 A/G | TTCACAGGGACGCTCAT (SEQ ID NO: 34377) |
| hCV25741844 C/T | CTAATGCTCTGATGTTGCTACTAAC (SEQ ID NO: 34380) |
| hCV25750908 C/T | CCTGATTGGGGAACAAC (SEQ ID NO: 34383) |
| hCV25766820 A/G | TCGAAGTCCTAAGCTCAAGT (SEQ ID NO: 34386) |
| hCV25932158 A/G | GCCGTGATAAACCTCTGT (SEQ ID NO: 34389) |
| hCV25934437 C/T | GATAGAGGAGTTAGAGCACTTGG (SEQ ID NO: 34392) |
| hCV25957240 C/T | TGAAGAACACCATTGCCA (SEQ ID NO: 34395) |
| hCV25984261 A/G | AAAAGTAATAACCACCAATTTCAT (SEQ ID NO: 34398) |

TABLE 5-continued

| | | |
|---|---|---|
| hCV2729190 | A/C | CCTGGAGTACAGCTTGAGGT (SEQ ID NO: 34401) |
| hCV2730005 | A/C | CCATTTGAGGTATGTTTTAAAAGT (SEQ ID NO: 34404) |
| hCV27915384 | A/G | TGAGAAAGAGAAGAGTGCCAT (SEQ ID NO: 34407) |
| hCV2821340 | A/G | CCGGAAAGACTTCTCTCCA (SEQ ID NO: 34410) |
| hCV2917913 | A/C | CAGAAGTTAGCTGAGGTCATAA (SEQ ID NO: 34413) |
| hCV2944794 | C/G | GCTTACTTACGTGGAAAGACTC (SEQ ID NO: 34416) |
| hCV3113062 | G/T | TTCAGAAAGAGGCGTCG (SEQ ID NO: 34419) |
| hCV3161768 | A/G | TCCCAGACCTCAGCCTA (SEQ ID NO: 34422) |
| hCV3277068 | C/T | AGATGTTACAACTTGATCAGTCG (SEQ ID NO: 34425) |
| hCV335227 | G/T | GCATGGGATGGAGGAG (SEQ ID NO: 34428) |
| hCV674099 | C/T | GCTACAAATGCTCACACCAG (SEQ ID NO: 34431) |
| hCV7241 | C/G | TGGTATGTTCCTGCTTCATC (SEQ ID NO: 34434) |
| hCV7450990 | A/C | TGGTCGAAGACAGAGGTG (SEQ ID NO: 34437) |
| hCV7466465 | C/T | CAACAGGCCCAAATACTTC (SEQ ID NO: 34440) |
| hCV7882185 | A/G | TCTGCATCTCATGCATCAGA (SEQ ID NO: 34443) |
| hCV8761599 | C/T | GGGATGGTGAGCAACG (SEQ ID NO: 34446) |
| hCV8853894 | G/T | GAACCCCGCGTGTG (SEQ ID NO: 34449) |
| hCV8902345 | C/T | GGGGAATTAGTCATAGGGTATC (SEQ ID NO: 34452) |
| hCV8934089 | G/T | ATTTAAACTGTTAATTCATACCACC (SEQ ID NO: 34455) |
| hCV9725216 | A/T | GTGGCATGGGTTGGTT (SEQ ID NO: 34458) |

| Marker | Sequence B (allele-specific primer) |
|---|---|
| hCV11176855 | TCAGTTCCCAATTCTATATGTCTT (SEQ ID NO: 34258) |
| hCV11291454 | AAACCAGCCAAATTCCTTT (SEQ ID NO: 34261) |
| hCV11486078 | AGCCCCAGAACCTGG (SEQ ID NO: 34264) |
| hCV11611200 | GGGATTTCAGGTGTGAGC (SEQ ID NO: 34267) |
| hCV11611201 | TTCCTGAGAAGTCAAGAAGC (SEQ ID NO: 34270) |
| hCV11638783 | AAGGGCTTCGGGGTAT (SEQ ID NO: 34273) |
| hCV11722237 | CAAAGTGATTTTGGGACAAT (SEQ ID NO: 34276) |
| hCV11743295 | ATCATTTCCTTACAATACTGTCC (SEQ ID NO: 34279) |
| hCV11745746 | GGGAGGTTATTGTGAACTAGC (SEQ ID NO: 34282) |
| hCV11749854 | GCTCATCTGCATCCGG (SEQ ID NO: 34285) |
| hCV11894038 | TATGAAAGATTTCAAATCCTCTG (SEQ ID NO: 34288) |
| hCV11935588 | TTTCTGCCTGGTCTGTGA (SEQ ID NO: 34291) |
| hCV11944682 | TGAAAACATTTAAAGTTTCCTCAT (SEQ ID NO: 34294) |
| hCV11955739 | CACTACCTCCCTCTAGGAGAAG (SEQ ID NO: 34297) |
| hCV1198609 | AGTTAAATGAATACACTGATGGAA (SEQ ID NO: 34300) |
| hCV11986235 | CCACTGGCCATCACG (SEQ ID NO: 34303) |
| hCV1259266 | GCTTAAGAGCAACCTCAGAGAT (SEQ ID NO: 34306) |
| hCV1283127 | CAGGCATGACATTGAAAG (SEQ ID NO: 34309) |
| hCV1478583 | GGTAGGTACCCGTGTTTACG (SEQ ID NO: 34312) |

TABLE 5-continued

| | | |
|---|---|---|
| hCV15851335 | GGATGGCATGGATGGT | (SEQ ID NO: 34315) |
| hCV15853499 | GAGCAGTCATGGAGAGCATA | (SEQ ID NO: 34318) |
| hCV15964790 | GCAGTATCTCTCTCCATCCA | (SEQ ID NO: 34321) |
| hCV16166459 | TGTCAGAATTTCATTTACTAGAATCCAT | (SEQ ID NO: 34324) |
| hCV16167920 | AGATTACAAAGGGTCCAGTG | (SEQ ID NO: 34327) |
| hCV1728296 | TATGGTAGGTGCTGAGAATATATG | (SEQ ID NO: 34330) |
| hCV1801154 | CCTCTTTTACTTCTTTCCTGG | (SEQ ID NO: 34333) |
| hCV1895513 | ACTTGAATAAAGCTGTATGACCTAT | (SEQ ID NO: 34336) |
| hCV192738 | TGCCCGTGGTCAGG | (SEQ ID NO: 34339) |
| hCV22271827 | TTGATGTTTTCTTGAATACACT | (SEQ ID NO: 34342) |
| hCV22272667 | CAGGCAAAAAGTCTTGAAC | (SEQ ID NO: 34345) |
| hCV22272823 | CGCTGGTGAGACCCG | (SEQ ID NO: 34348) |
| hCV22274307 | GACCTACGCTCCTTCATCTAAT | (SEQ ID NO: 34351) |
| hCV22274712 | CTTACAGAAGGACATCCTTTACAC | (SEQ ID NO: 34354) |
| hCV2231920 | CACTCCAGCACATAGAGGAC | (SEQ ID NO: 34357) |
| hCV2231945 | GCCTGCTCCCTCATCT | (SEQ ID NO: 34360) |
| hCV2351160 | CCACCAGTGGCTATCG | (SEQ ID NO: 34363) |
| hCV2384392 | CAAATGCTAGCAGCCCT | (SEQ ID NO: 34366) |
| hCV2479345 | TCCTGAAAGGGTTGAACTG | (SEQ ID NO: 34369) |
| hCV25600642 | CGCGGCCGAAGG | (SEQ ID NO: 34372) |
| hCV25609481 | TGCTGAGGCAATTAACTAAATG | (SEQ ID NO: 34375) |
| hCV25639661 | TTCACAGGGACGCTCAC | (SEQ ID NO: 34378) |
| hCV25741844 | CTAATGCTCTGATGTTGCTACTAAT | (SEQ ID NO: 34381) |
| hCV25750908 | CCTGATTGGGGGAACAAT | (SEQ ID NO: 34384) |
| hCV25766820 | CGAAGTCCTAAGCTCAAGC | (SEQ ID NO: 34387) |
| hCV25932158 | CCGTGATAAACCTCTGC | (SEQ ID NO: 34390) |
| hCV25934437 | AGATAGAGGAGTTAGAGCACTTGA | (SEQ ID NO: 34393) |
| hCV25957240 | GAAGAACACCATTGCCG | (SEQ ID NO: 34396) |
| hCV25984261 | AAAAGTAATAACCACCAATTTCAC | (SEQ ID NO: 34399) |
| hCV2729190 | CTGGAGTACAGCTTGAGGG | (SEQ ID NO: 34402) |
| hCV2730005 | CATTTGAGGTATGTTTTAAAAGG | (SEQ ID NO: 34405) |
| hCV27915384 | TGAGAAAGAGAAGAGTGCCAC | (SEQ ID NO: 34408) |
| hCV2821340 | CGGAAAGACTTCTCTCCG | (SEQ ID NO: 34411) |
| hCV2917913 | CAGAAGTTAGCTGAGGTCATAC | (SEQ ID NO: 34414) |
| hCV2944794 | GCTTACTTACGTGGAAAGACTG | (SEQ ID NO: 34417) |
| hCV3113062 | AGATTCAGAAAGAGGCGTCT | (SEQ ID NO: 34420) |
| hCV3161768 | CCCAGACCTCAGCCTG | (SEQ ID NO: 34423) |
| hCV3277068 | CAGATGTTACAACTTGATCAGTCA | (SEQ ID NO: 34426) |
| hCV335227 | GCATGGGATGGAGGAT | (SEQ ID NO: 34429) |
| hCV674099 | GCTACAAATGCTCACACCAA | (SEQ ID NO: 34432) |

TABLE 5-continued

| Marker | Sequence |
|---|---|
| hCV7241 | TGGTATGTTCCTGCTTCATG (SEQ ID NO: 34435) |
| hCV7450990 | TTGGTCGAAGACAGAGGTT (SEQ ID NO: 34438) |
| hCV7466465 | CAACAGGCCCAAATACTTT (SEQ ID NO: 34441) |
| hCV7882185 | CTGCATCTCATGCATCAGG (SEQ ID NO: 34444) |
| hCV8761599 | AGGGATGGTGAGCAACA (SEQ ID NO: 34447) |
| hCV8853894 | GAACCCCGCGTGTT (SEQ ID NO: 34450) |
| hCV8902345 | GGGGAATTAGTCATAGGGTATT (SEQ ID NO: 34453) |
| hCV8934089 | AATTTAAACTGTTAATTCATACCACA (SEQ ID NO: 34456) |
| hCV9725216 | TGTGGCATGGGTTGGTA (SEQ ID NO: 34459) |

| Marker | Sequence C (common primer) |
|---|---|
| hCV11176855 | TTGCTCCATCAAACTGTGAA (SEQ ID NO: 34259) |
| hCV11291454 | ACACCCACGGTGATTGAT (SEQ ID NO: 34262) |
| hCV11486078 | GGGCTGGGCTTGTAGAATA (SEQ ID NO: 34265) |
| hCV11611200 | CTGCTCTTTGGAGGAAGTGAAAGATAAT (SEQ ID NO: 34268) |
| hCV11611201 | TCTCTGGCTTTCTCAGCACTCA (SEQ ID NO: 34271) |
| hCV11638783 | ACCGTGCAGGGTCTTCT (SEQ ID NO: 34274) |
| hCV11722237 | GAATACTGAAAACTCACTCATTTGT (SEQ ID NO: 34277) |
| hCV11743295 | CCATTAACAAGCATTGTACTGTTAGT (SEQ ID NO: 34280) |
| hCV11745746 | AGACAGATCGATGACAGATTAAGT (SEQ ID NO: 34283) |
| hCV11749854 | CCCATGCCTTCATCACAT (SEQ ID NO: 34286) |
| hCV11894038 | CTGAAGAGGGTCTTTTCCA (SEQ ID NO: 34289) |
| hCV11935588 | CTCACTTTGCACAGGTTGTACT (SEQ ID NO: 34292) |
| hCV11944682 | TTCACTGAAGGGCTCACTATTA (SEQ ID NO: 34295) |
| hCV11955739 | GATCTCATGGCTTCTGTTCAG (SEQ ID NO: 34298) |
| hCV1198609 | TTGCTGCTGATGACTTTAGAGT (SEQ ID NO: 34301) |
| hCV11986235 | CCTTTGTAGACCTGTTCCTCTATC (SEQ ID NO: 34304) |
| hCV1259266 | AACTGGCTGAACTGTGACAC (SEQ ID NO: 34307) |
| hCV1283127 | CAGAATGTAGTCTCGATTCTTCTTC (SEQ ID NO: 34310) |
| hCV1478583 | ACAGGAGAGTAACATGACAGTATGT (SEQ ID NO: 34313) |
| hCV15851335 | GCAGGATGTGCTGTGATTAT (SEQ ID NO: 34316) |
| hCV15853499 | ACACCAGAATGAGAAAGGTAAGTA (SEQ ID NO: 34319) |
| hCV15964790 | CTGACTCTGATGAGAAGTTTATCAC (SEQ ID NO: 34322) |
| hCV16166459 | GATGAGCTGCCTAAATTTGAGAAGA (SEQ ID NO: 34325) |
| hCV16167920 | CTGCAGCTCTTTCAGAGAGTT (SEQ ID NO: 34328) |
| hCV1728296 | AAGGAGTGAGGAAGCAAAGATT (SEQ ID NO: 34331) |
| hCV1801154 | GTCACACTGAAGAGTCAATGACTAT (SEQ ID NO: 34334) |
| hCV1895513 | CCACCATCTGGATTCTTTAAG (SEQ ID NO: 34337) |
| hCV192738 | GCTGCATCCGTGTATCTGT (SEQ ID NO: 34340) |
| hCV22271827 | AGAGTGAAATTTTTCTTTTGTCTTA (SEQ ID NO: 34343) |
| hCV22272667 | CCCCCCATAACATTCAGATAT (SEQ ID NO: 34346) |

TABLE 5-continued

| | |
|---|---|
| hCV22272823 | GGAGCGCGCTTCTGT (SEQ ID NO: 34349) |
| hCV22274307 | CAATGTGATTACCTCAAAATAATATCTAC (SEQ ID NO: 34352) |
| hCV22274712 | GCAGGCCCAAGATTGAT (SEQ ID NO: 34355) |
| hCV2231920 | CAGCAGCTTTTGTCTGTGTG (SEQ ID NO: 34358) |
| hCV2231945 | TGGTGAAGCAGACAGGAACTA (SEQ ID NO: 34361) |
| hCV2351160 | GGCAAGCAGGCTTGAGAA (SEQ ID NO: 34364) |
| hCV2384392 | TCCCAGAGAGGAAGAGACTG (SEQ ID NO: 34367) |
| hCV2479345 | CAACTCCTGGGCTGAATG (SEQ ID NO: 34370) |
| hCV25600642 | GATGACCCGGACGACTAC (SEQ ID NO: 34373) |
| hCV25609481 | TGGAACAACTTTATTCGAAGTAAG (SEQ ID NO: 34376) |
| hCV25639661 | GGTTAATTCTGGATCTCAAGTATG (SEQ ID NO: 34379) |
| hCV25741844 | CGAGAAAAGGCTGAGTTTTATAG (SEQ ID NO: 34382) |
| hCV25750908 | CATCTGCAACCCTCTTAGATATAC (SEQ ID NO: 34385) |
| hCV25766820 | GGGACCACAGGTTGCTGAAATTTA (SEQ ID NO: 34388) |
| hCV25932158 | TTTGATTGGCAATGTTTACAA (SEQ ID NO: 34391) |
| hCV25934437 | CTCGAAGCTGAAGAAGAGATAAC (SEQ ID NO: 34394) |
| hCV25957240 | GTGGGAGAGGAAAGACAGTAAT (SEQ ID NO: 34397) |
| hCV25984261 | CACCTTCCCCGTTGACTA (SEQ ID NO: 34400) |
| hCV2729190 | CCAGGTCTCGGACACTGA (SEQ ID NO: 34403) |
| hCV2730005 | GCTGCCTGCTGTCTTTTAAC (SEQ ID NO: 34406) |
| hCV27915384 | CTTCCACCTTCCAGCTTACT (SEQ ID NO: 34409) |
| hCV2821340 | TTGTATCTGGTGAATCTGAACTAAG (SEQ ID NO: 34412) |
| hCV2917913 | GCCTGGCCAAATTAATTTCTTTCT (SEQ ID NO: 34415) |
| hCV2944794 | TCTTCTGATGGTTGCTCTACTC (SEQ ID NO: 34418) |
| hCV3113062 | GGCCGAAAGCTGTTCAC (SEQ ID NO: 34421) |
| hCV3161768 | TGTGGCCACTCAGGTTCATAT (SEQ ID NO: 34424) |
| hCV3277068 | CGGCAGGATGGTTCTGTA (SEQ ID NO: 34427) |
| hCV335227 | GCGATGGATGGTCTGAGTTA (SEQ ID NO: 34430) |
| hCV674099 | GCCAGAATTTTGTTAATTTCATACT (SEQ ID NO: 34433) |
| hCV7241 | CAGGCAGGAGATGTGTGAG (SEQ ID NO: 34436) |
| hCV7450990 | GTTTTCACATTCAAGGTTTTACTC (SEQ ID NO: 34439) |
| hCV7466465 | CGTGGTAAACAATGCAGTAACT (SEQ ID NO: 34442) |
| hCV7882185 | GGACTAGACCCAGGATTTAGTTGT (SEQ ID NO: 34445) |
| hCV8761599 | GAACTTGAGGCTTGCAAAGGTTAAG (SEQ ID NO: 34448) |
| hCV8853894 | CCAGTGGTCCTGTCTCTGTA (SEQ ID NO: 34451) |
| hCV8902345 | GCTTACCCAGACTTTAAAAATACAC (SEQ ID NO: 34454) |
| hCV8934089 | TTTGCTCCAACCTCATACAG (SEQ ID NO: 34457) |
| hCV9725216 | GAGATACAGGCCAAGGAGAAT (SEQ ID NO: 34460) |

TABLE 6

| | | "Stanford Samples" (stage) | | | | "UCSF Samples" (stage) | | | |
|---|---|---|---|---|---|---|---|---|---|
| Marker | Gene symbol | OR | LCL | UCL | p-val | OR | LCL | UCL | p-val |
| 11638783 ord | EPHX1 | 0.408 | 0.195 | 0.855 | 0.0175 | 0.583 | 0.419 | 0.811 | 0.0014 |
| 11638783 dom | EPHX1 | 0.291 | 0.118 | 0.715 | 0.0071 | 0.586 | 0.402 | 0.855 | 0.0055 |

Markers replicated between "Stanford Samples" and "UCSF Samples": Stage analysis

TABLE 7

| Marker | Risk allele | Strata | UCSF CT AF | UCSF CASE AF | UCSF OR | UCSF P_2tail | VCU CT AF | VCU CASE AF | VCU OR | VCU P_1tail | UIC CT AF | UIC CASE AF | UIC OR | UIC P_1tail | Stanford CT AF | Stanford CASE AF | Stanford OR | Stanford P_1tail |
|---|---|---|---|---|---|---|---|---|---|---|---|---|---|---|---|---|---|---|
| hCV11176855 | T | A | 29.5% | 36.3% | 1.37 | 0.0337026 | 24.9% | 31.8% | 1.40 | 0.0093974 | 23.5% | 29.8% | 1.39 | 0.1411424 | 32.0% | 34.2% | 1.08 | 0.4074309 |
| hCV11176855 | T | C | 27.9% | 34.6% | 1.36 | 0.0954968 | 26.5% | 32.5% | 1.34 | 0.0464593 | 27.8% | 29.5% | 1.09 | 0.5 | 30.6% | 25.0% | 0.76 | 0.6729877 |
| hCV11176855 | T | O | 32.7% | 40.2% | 1.39 | 0.2313618 | 21.4% | 30.0% | 1.57 | 0.0513496 | 20.0% | 30.0% | 1.71 | 0.1050529 | 34.8% | 44.7% | 1.52 | 0.1889789 |
| hCV11291454 | A | A | 58.5% | 71.6% | 1.81 | 0.0001649 | 53.6% | 61.5% | 1.37 | 0.0116582 | 50.7% | 51.1% | 0.89 | 0.6622836 | 66.9% | 67.1% | 1.24 | 0.2590044 |
| hCV11291454 | A | C | 68.0% | 78.2% | 1.69 | 0.0091148 | 64.0% | 70.7% | 1.36 | 0.0305606 | 67.3% | 70.5% | 1.16 | 0.4132722 | 75.0% | 80.6% | 1.38 | 0.3156947 |
| hCV11291454 | A | O | 38.7% | 56.3% | 2.04 | 0.0065569 | 30.5% | 37.7% | 1.38 | 0.1053606 | 41.3% | 34.0% | 0.73 | 0.7692901 | 52.1% | 55.3% | 1.14 | 0.4147957 |
| hCV11486078 | G | A | 89.8% | 93.3% | 1.58 | 0.0893912 | 88.4% | 94.0% | 2.02 | 0.0016633 | 89.7% | 77.7% | 0.37 | 0.9968868 | 93.4% | 92.1% | 0.89 | 0.5860968 |
| hCV11486078 | G | C | 91.0% | 94.1% | 1.59 | 0.2170872 | 93.6% | 95.9% | 1.58 | 0.1154633 | 88.9% | 88.6% | 0.98 | 0.5 | 95.8% | 91.7% | 0.48 | 0.800967 |
| hCV11486078 | G | O | 87.3% | 91.5% | 1.56 | 0.4301119 | 76.6% | 89.2% | 2.53 | 0.0037163 | 91.3% | 68.0% | 0.20 | 0.6076692 | 89.1% | 92.1% | 1.42 | 0.3618481 |
| hCV11611200 | G | A | 74.4% | 68.9% | 0.76 | 0.0796464 | 77.9% | 74.4% | 0.82 | 0.096286 | 77.2% | 78.7% | 1.09 | 0.8219494 | 78.2% | 75.0% | 0.82 | 0.2847136 |
| hCV11611200 | G | C | 74.3% | 68.6% | 0.76 | 0.15363 | 75.1% | 75.1% | 0.87 | 0.2356728 | 70.4% | 79.5% | 1.64 | 0.3240005 | 69.4% | 72.2% | 1.14 | 0.5869379 |
| hCV11611200 | G | O | 74.6% | 69.5% | 0.78 | 0.3907832 | 78.6% | 72.3% | 0.71 | 0.1332211 | 82.5% | 78.0% | 0.75 | 0.1101368 | 89.6% | 78.9% | 0.44 | 0.1143356 |
| hCV11611201 | G | A | 64.6% | 63.7% | 0.98 | 0.8635623 | 67.3% | 67.8% | 1.07 | 0.6903024 | 70.1% | 60.6% | 0.70 | 0.8450457 | 57.3% | 51.3% | 0.79 | 0.2124562 |
| hCV11611201 | G | C | 58.6% | 63.3% | 1.22 | 0.300442 | 56.7% | 61.0% | 1.20 | 0.1377058 | 57.4% | 45.5% | 0.62 | 0.3350385 | 62.5% | 55.6% | 0.75 | 0.732383 |
| hCV11611201 | G | O | 76.9% | 64.6% | 0.55 | 0.0308725 | 90.9% | 85.4% | 0.58 | 0.0964825 | 78.2% | 74.0% | 0.79 | 0.6355253 | 52.1% | 47.4% | 0.83 | 0.41414 |
| hCV11722237 | T | A | 6.1% | 3.3% | 0.52 | 0.0706133 | 5.0% | 2.8% | 0.53 | 0.031106 | 2.9% | 4.3% | 1.29 | 0.6515311 | 8.1% | 3.9% | 0.35 | 0.0813783 |
| hCV11722237 | T | C | 8.1% | 3.7% | 0.44 | 0.0457985 | 6.1% | 3.3% | 0.52 | 0.0511311 | 5.6% | 9.1% | 1.70 | 0.5 | 11.1% | 5.6% | 0.47 | 0.2453536 |
| hCV11722237 | T | O | 1.9% | 2.4% | 1.28 | 0.6747832 | 2.6% | 1.5% | 0.58 | 0.6550289 | 1.3% | 0.0% | 0.52 | 0.1068476 | 4.2% | 0.0% | 0.24 | 0.7495212 |
| hCV11743295 | G | A | 88.1% | 92.2% | 1.60 | 0.0626577 | 88.0% | 91.0% | 1.37 | 0.0687578 | 81.6% | 89.4% | 1.66 | 0.1449274 | 87.1% | 93.4% | 2.51 | 0.051189 |
| hCV11743295 | G | C | 89.7% | 93.6% | 1.68 | 0.144084 | 88.7% | 92.9% | 1.67 | 0.0320542 | 88.9% | 95.5% | 2.63 | 0.2509392 | 84.7% | 91.7% | 1.98 | 0.1887544 |
| hCV11743295 | G | O | 84.6% | 89.0% | 1.47 | 0.3702058 | 86.4% | 86.2% | 0.98 | 0.5 | 78.8% | 84.0% | 1.42 | 0.5336522 | 89.6% | 97.4% | 4.30 | 0.110807 |
| hCV11745746 | G | A | 90.0% | 95.2% | 2.20 | 0.0097508 | 83.7% | 91.2% | 2.20 | 0.9981004 | 78.7% | 79.8% | 0.97 | 0.7781595 | 88.7% | 96.1% | 3.32 | 0.018827 |
| hCV11745746 | G | C | 97.4% | 97.3% | 0.97 | 1 | 95.9% | 99.4% | 7.13 | 0.0099604 | 90.7% | 100.0% | 9.89 | 0.5 | 95.8% | 94.4% | 0.74 | 0.5 |
| hCV11745746 | G | O | 74.4% | 90.2% | 3.18 | 0.0019923 | 56.5% | 70.0% | 1.80 | 0.0031343 | 70.0% | 62.0% | 0.70 | 0.1068476 | 77.1% | 97.4% | 11.00 | 0.004977 |
| hCV11749854 | T | A | 81.8% | 77.0% | 0.75 | 0.0996729 | 85.9% | 78.8% | 0.62 | 0.0030488 | 84.6% | 87.2% | 1.34 | 0.7685416 | 79.0% | 73.7% | 0.78 | 0.2459388 |
| hCV11749854 | T | C | 77.4% | 72.9% | 0.78 | 0.2330053 | 81.7% | 72.8% | 0.60 | 0.0030488 | 79.8% | 81.8% | 1.15 | 0.5 | 80.6% | 77.8% | 0.84 | 0.4008579 |
| hCV11749854 | T | O | 91.2% | 86.6% | 0.63 | 0.2883911 | 95.5% | 94.6% | 0.84 | 0.3942691 | 87.5% | 92.0% | 1.64 | 0.7177247 | 77.1% | 71.1% | 0.73 | 0.3104902 |
| hCV11894038 | G | A | 42.3% | 51.5% | 1.43 | 0.011397 | 38.3% | 44.4% | 1.27 | 0.0353759 | 29.4% | 35.1% | 1.22 | 0.2469900 | 41.1% | 47.4% | 1.53 | 0.0790406 |
| hCV11694038 | G | C | 47.4% | 55.3% | 1.37 | 0.063105 | 42.2% | 50.0% | 1.02 | 0.0228613 | 40.7% | 40.9% | 1.01 | 0.5 | 52.8% | 52.8% | 1.00 | 0.5 |
| hCV11894038 | G | O | 31.6% | 42.5% | 1.60 | 0.0803792 | 29.6% | 30.0% | 0.72 | 0.000135 | 22.5% | 30.0% | 1.48 | 0.2042361 | 25.2% | 44.7% | 2.72 | 0.0195193 |
| hCV11935588 | T | A | 90.9% | 83.2% | 0.50 | 0.00005557 | 89.8% | 85.5% | 0.69 | 0.030135 | 94.1% | 89.4% | 0.50 | 0.0915285 | 89.5% | 89.5% | 0.45 | 0.0624204 |
| hCV11935588 | T | C | 89.3% | 81.2% | 0.51 | 0.0051002 | 86.9% | 81.7% | 0.67 | 0.0365596 | 90.7% | 79.5% | 0.40 | 0.0750036 | 97.2% | 83.3% | 0.14 | 0.007968 |
| hCV11935588 | T | O | 94.2% | 87.8% | 0.44 | 0.0845845 | 96.1% | 95.4% | 0.84 | 0.388138 | 97.5% | 98.0% | 1.26 | 0.5 | 91.7% | 94.7% | 1.64 | 0.6551712 |
| hCV11944682 | T | A | 69.7% | 78.5% | 1.60 | 0.00062925 | 71.2% | 75.6% | 1.26 | 0.0576985 | 71.3% | 71.3% | 0.94 | 0.5844489 | 69.4% | 78.9% | 1.80 | 0.0464023 |
| hCV11944682 | T | C | 67.8% | 78.7% | 1.75 | 0.0052231 | 70.6% | 75.7% | 1.30 | 0.0711081 | 74.1% | 72.7% | 0.93 | 0.5 | 68.1% | 77.8% | 1.64 | 0.184606 |
| hCV11944682 | T | O | 73.5% | 78.0% | 1.28 | 0.4683295 | 72.4% | 75.4% | 1.17 | 0.2947384 | 71.3% | 70.0% | 0.94 | 0.5 | 68.8% | 81.6% | 2.01 | 0.1089093 |
| hCV11955739 | G | A | 91.5% | 84.8% | 0.52 | 0.0018691 | 92.5% | 89.1% | 0.68 | 0.0435773 | 93.4% | 88.3% | 0.54 | 0.0978022 | 87.9% | 88.2% | 1.12 | 0.5975364 |
| hCV11955739 | G | C | 90.4% | 79.8% | 0.42 | 0.000265 | 90.1% | 86.7% | 0.72 | 0.094331 | 96.3% | 84.1% | 0.20 | 0.0369249 | 86.1% | 86.1% | 1.00 | 0.5 |
| hCV11955739 | G | O | 93.8% | 96.3% | 1.73 | 0.5809754 | 98.0% | 95.4% | 0.42 | 0.8449941 | 91.3% | 92.0% | 1.10 | 0.5 | 89.6% | 92.1% | 1.36 | 0.5 |
| hCV1198609 | T | A | 6.4% | 11.5% | 2.14 | 0.0024034 | 2.8% | 5.6% | 2.19 | 0.0096633 | 8.1% | 9.6% | 1.27 | 0.3063578 | 9.7% | 11.8% | 0.99 | 0.5218036 |
| hCV1198609 | T | C | 2.6% | 2.7% | 1.03 | 1 | 1.5% | 2.7% | 1.84 | 0.1471146 | 3.7% | 4.5% | 1.24 | 0.5 | 0.0% | 5.6% | 10.51 | 0.9454829 |
| hCV1198609 | T | O | 14.3% | 31.7% | 2.77 | 0.0009268 | 5.8% | 13.1% | 2.42 | 0.0200566 | 11.3% | 14.0% | 1.28 | 0.3923433 | 25.0% | 18.4% | 0.68 | 0.6987978 |
| hCV11986235 | G | A | 96.2% | 93.3% | 0.55 | 0.0517609 | 96.8% | 94.4% | 0.58 | 0.0435025 | 96.3% | 97.9% | 1.46 | 0.6625662 | 98.4% | 98.7% | 1.19 | 0.5530895 |
| hCV11986235 | G | C | 95.2% | 91.5% | 0.54 | 0.0697466 | 96.2% | 93.2% | 0.54 | 0.0438543 | 98.1% | 95.9% | 0.40 | 0.2930123 | 97.2% | 100.0% | 2.59 | 0.2757009 |
| hCV11986235 | G | O | 98.4% | 97.5% | 0.62 | 0.6311623 | 98.1% | 97.7% | 0.84 | 0.5 | 96.3% | 100.0% | 4.56 | 0.1422182 | 100.0% | 97.4% | 0.26 | 0.2209302 |
| hCV1259266 | T | A | 43.2% | 51.1% | 1.37 | 0.0323507 | 36.5% | 47.4% | 1.58 | 0.0005479 | 31.6% | 29.8% | 0.78 | 0.7841436 | 46.0% | 50.0% | 1.21 | 0.265656 |
| hCV1259266 | T | C | 50.6% | 60.1% | 1.47 | 0.0273133 | 47.4% | 58.3% | 1.55 | 0.0022566 | 55.6% | 45.5% | 0.67 | 0.7916225 | 55.6% | 50.0% | 0.80 | 0.6584099 |

TABLE 7-continued

| Marker | Risk allele | Strata | UCSF CT AF | UCSF CASE AF | UCSF OR | UCSF P_2tail | VCU CT AF | VCU CASE AF | VCU OR | VCU P_1tail | UIC CT AF | UIC CASE AF | UIC OR | UIC P_1tail | Stanford CT AF | Stanford CASE AF | Stanford OR | Stanford P_1tail |
|---|---|---|---|---|---|---|---|---|---|---|---|---|---|---|---|---|---|---|
| hCV1259266 | T | O | 27.7% | 30.0% | 1.12 | 0.7761833 | 12.3% | 19.2% | 1.69 | 0.0691347 | 16.3% | 16.0% | 0.96 | 0.5 | 31.3% | 47.4% | 1.98 | 0.0901214 |
| hCV1283127 | G | A | 33.1% | 27.0% | 0.75 | 0.066346 | 34.1% | 29.5% | 0.81 | 0.067913 | 33.8% | 30.9% | 0.90 | 0.3580695 | 29.8% | 27.6% | 0.91 | 0.3819914 |
| hCV1283127 | G | C | 32.0% | 24.5% | 0.69 | 0.0533312 | 32.3% | 28.1% | 0.82 | 0.1220061 | 31.5% | 25.0% | 0.73 | 0.2545188 | 26.4% | 30.6% | 1.23 | 0.6724109 |
| hCV1283127 | G | O | 35.4% | 32.9% | 0.90 | 0.7904387 | 38.3% | 33.1% | 0.80 | 0.1932143 | 35.0% | 36.0% | 1.04 | 0.5 | 35.4% | 26.3% | 0.65 | 0.2417924 |
| hCV1478583 | G | A | 86.7% | 91.1% | 1.57 | 0.0662621 | 79.7% | 88.2% | 2.05 | 0.0002096 | 77.9% | 81.9% | 1.18 | 0.3232367 | 87.9% | 85.5% | 0.99 | 0.5208237 |
| hCV1478583 | G | C | 94.7% | 96.3% | 1.46 | 0.4396698 | 94.8% | 96.2% | 1.38 | 0.231632 | 96.3% | 97.7% | 1.65 | 0.4246091 | 97.2% | 91.7% | 0.31 | 0.8346649 |
| hCV1478583 | G | O | 70.0% | 79.3% | 1.64 | 0.1201572 | 46.1% | 67.7% | 2.45 | 0.0001557 | 65.0% | 68.0% | 1.14 | 0.4338886 | 72.9% | 78.9% | 1.39 | 0.3083447 |
| hCV15851335 | T | A | 5.8% | 1.9% | 0.30 | 0.0072754 | 7.0% | 4.3% | 0.56 | 0.0227665 | 2.2% | 2.1% | 0.85 | 0.5 | 6.5% | 0.0% | 0.09 | 0.0148286 |
| hCV15851335 | T | C | 7.2% | 2.1% | 0.28 | 0.010777 | 9.6% | 5.6% | 0.56 | 0.0301778 | 3.7% | 4.5% | 1.24 | 0.5 | 8.3% | 0.0% | 0.14 | 0.0877663 |
| hCV15851335 | T | O | 3.1% | 1.2% | 0.39 | 0.6924577 | 1.3% | 0.8% | 0.59 | 0.5 | 1.3% | 0.0% | 0.52 | 0.5 | 4.2% | 0.0% | 0.24 | 0.2504788 |
| hCV15853499 | T | A | 95.5% | 92.6% | 0.59 | 0.0618752 | 96.3% | 94.0% | 0.61 | 0.0520397 | 96.3% | 90.4% | 0.38 | 0.0385316 | 88.7% | 90.8% | 1.20 | 0.6425593 |
| hCV15853499 | T | C | 94.9% | 94.1% | 0.87 | 0.70811211 | 95.3% | 92.3% | 0.59 | 0.056015 | 94.4% | 90.9% | 0.59 | 0.3486228 | 90.3% | 91.7% | 1.18 | 0.5 |
| hCV15853499 | T | O | 96.9% | 89.0% | 0.26 | 0.0077447 | 98.7% | 98.5% | 0.84 | 0.5 | 97.5% | 90.0% | 0.23 | 0.0532156 | 87.5% | 89.5% | 1.21 | 0.5 |
| hCV15964790 | T | A | 93.6% | 88.1% | 0.51 | 0.0039712 | 93.6% | 91.2% | 0.73 | 0.1032006 | 91.9% | 91.5% | 1.07 | 0.5545812 | 86.3% | 94.7% | 3.29 | 0.9750382 |
| hCV15964790 | T | C | 93.3% | 86.7% | 0.47 | 0.008645 | 92.2% | 89.1% | 0.69 | 0.0947529 | 85.2% | 84.1% | 0.92 | 0.5 | 84.7% | 91.7% | 1.98 | 0.8112456 |
| hCV15964790 | T | O | 94.1% | 91.3% | 0.65 | 0.4359617 | 96.8% | 96.9% | 1.06 | 0.5 | 96.3% | 98.0% | 1.91 | 0.5 | 89.6% | 100.0% | 9.74 | 0.0317899 |
| hCV16166459 | T | A | 21.0% | 14.1% | 0.61 | 0.0134207 | 25.5% | 19.4% | 0.70 | 0.0235762 | 37.5% | 34.0% | 1.00 | 0.5191415 | 14.5% | 6.6% | 0.31 | 0.013379 |
| hCV16166459 | T | C | 9.2% | 8.5% | 0.92 | 0.8829064 | 9.3% | 7.1% | 0.75 | 0.1650372 | 5.6% | 9.1% | 1.70 | 0.6513772 | 4.2% | 2.8% | 0.66 | 0.5 |
| hCV16166459 | T | O | 45.8% | 26.8% | 0.43 | 0.0029464 | 61.7% | 51.5% | 0.66 | 0.0465309 | 58.9% | 56.0% | 0.89 | 0.4277638 | 31.3% | 10.5% | 0.26 | 0.0173445 |
| hCV16167920 | C | A | 10.8% | 6.7% | 0.59 | 0.0660072 | 12.4% | 9.0% | 0.72 | 0.0685366 | 18.4% | 14.9% | 0.86 | 0.3461091 | 11.3% | 10.5% | 0.87 | 0.3817314 |
| hCV16167920 | C | C | 4.4% | 1.1% | 0.23 | 0.0374108 | 6.4% | 3.0% | 0.45 | 0.0225512 | 7.4% | 6.8% | 0.91 | 0.5 | 4.2% | 8.3% | 2.09 | 0.800967 |
| hCV16167920 | C | O | 24.2% | 20.0% | 0.78 | 0.5440817 | 26.0% | 24.6% | 0.93 | 0.4456023 | 25.0% | 22.0% | 0.85 | 0.4165074 | 20.8% | 13.2% | 0.58 | 0.201779 |
| hCV1728296 | G | A | 47.4% | 47.0% | 0.97 | 0.8217364 | 44.4% | 47.2% | 1.08 | 0.7041688 | 32.4% | 37.2% | 1.18 | 0.7177985 | 45.2% | 56.6% | 1.79 | 0.974872 |
| hCV1728296 | G | C | 57.2% | 51.1% | 0.78 | 0.1489372 | 58.1% | 56.6% | 0.94 | 0.3494331 | 50.0% | 45.5% | 0.83 | 0.3442489 | 59.7% | 58.3% | 0.94 | 0.5 |
| hCV1728296 | G | O | 26.6% | 37.8% | 1.68 | 0.0692913 | 13.6% | 23.1% | 1.90 | 0.0221246 | 20.0% | 30.0% | 1.71 | 0.1050529 | 20.8% | 52.6% | 4.22 | 0.0014959 |
| hCV1801154 | G | A | 42.8% | 48.9% | 1.28 | 0.0859458 | 44.5% | 50.9% | 1.30 | 0.022824 | 51.5% | 54.3% | 1.14 | 0.3116424 | 45.2% | 50.0% | 1.23 | 0.2453778 |
| hCV1801154 | G | C | 41.1% | 50.5% | 1.47 | 0.0313319 | 42.7% | 50.3% | 1.36 | 0.027081 | 53.7% | 40.9% | 0.60 | 0.8857355 | 48.6% | 55.6% | 1.32 | 0.2721597 |
| hCV1801154 | G | O | 46.7% | 45.0% | 0.93 | 0.7976721 | 48.7% | 52.3% | 1.16 | 0.7244534 | 50.0% | 66.0% | 1.94 | 0.9491307 | 41.7% | 44.7% | 1.13 | 0.5857485 |
| hCV1895513 | T | A | 21.8% | 16.7% | 0.71 | 0.0639765 | 24.1% | 20.1% | 0.79 | 0.0676873 | 17.6% | 23.4% | 1.40 | 0.8437975 | 21.0% | 7.9% | 0.32 | 0.0075906 |
| hCV1895513 | T | C | 23.7% | 18.6% | 0.74 | 0.1567194 | 22.7% | 21.3% | 0.92 | 0.3558691 | 18.5% | 22.7% | 1.29 | 0.6879993 | 23.6% | 5.6% | 0.19 | 0.0148618 |
| hCV1895513 | T | O | 17.8% | 12.2% | 0.64 | 0.3048613 | 27.3% | 16.9% | 0.54 | 0.0229026 | 17.5% | 24.0% | 1.49 | 0.8114331 | 18.8% | 10.5% | 0.51 | 0.1854525 |
| hCV192738 | G | A | 19.0% | 12.6% | 0.60 | 0.0132259 | 19.7% | 16.0% | 0.76 | 0.0546488 | 17.6% | 19.1% | 1.10 | 0.6029358 | 18.5% | 14.5% | 0.74 | 0.2226355 |
| hCV192738 | G | C | 21.7% | 14.9% | 0.63 | 0.0448195 | 23.3% | 17.8% | 0.71 | 0.0438758 | 14.8% | 20.5% | 1.48 | 0.7033718 | 16.7% | 19.4% | 1.21 | 0.6046873 |
| hCV192738 | G | O | 13.5% | 7.3% | 0.51 | 0.1725374 | 11.7% | 11.5% | 0.99 | 0.5 | 20.0% | 18.0% | 0.88 | 0.4115959 | 22.9% | 10.5% | 0.40 | 0.0805099 |
| hCV22271827 | T | A | 92.5% | 97.8% | 3.73 | 0.001979 | 85.7% | 91.7% | 1.93 | 0.0031921 | 81.6% | 80.9% | 0.93 | 0.7960524 | 92.7% | 94.7% | 1.96 | 0.1465974 |
| hCV22271827 | T | C | 98.9% | 100.0% | 4.58 | 0.3472479 | 98.0% | 99.7% | 7.00 | 0.9656028 | 98.1% | 100.0% | 2.50 | 0.5 | 100.0% | 100.0% | 0.50 | 0.5 |
| hCV22272667 | G | A | 78.9% | 92.5% | 3.30 | 0.0043726 | 58.4% | 70.8% | 1.72 | 0.0175525 | 72.5% | 64.0% | 0.67 | 0.8332934 | 81.3% | 89.5% | 1.96 | 0.1854525 |
| hCV22272667 | G | C | 67.5% | 72.0% | 1.23 | 0.1909631 | 65.9% | 72.1% | 1.32 | 0.0263995 | 61.9% | 59.6% | 0.86 | 0.7122417 | 66.9% | 71.1% | 1.34 | 0.186041 |
| hCV22272667 | G | O | 71.1% | 77.7% | 1.41 | 0.0872495 | 71.6% | 76.8% | 1.35 | 0.0601687 | 77.8% | 63.6% | 0.50 | 0.9114728 | 68.1% | 72.2% | 1.22 | 0.4124901 |
| hCV22272823 | G | A | 59.9% | 58.8% | 0.96 | 0.8966358 | 52.6% | 60.0% | 1.35 | 0.8843551 | 51.3% | 56.0% | 1.21 | 0.6415703 | 62.5% | 71.1% | 1.47 | 0.7534556 |
| hCV22272823 | G | C | 81.6% | 73.1% | 0.60 | 0.0022796 | 84.5% | 80.9% | 0.78 | 0.0691569 | 83.1% | 87.2% | 1.46 | 0.8356282 | 80.6% | 77.6% | 0.75 | 0.2130584 |
| hCV22272823 | G | O | 82.4% | 73.4% | 0.59 | 0.010691 | 85.8% | 79.2% | 0.63 | 0.0131899 | 79.6% | 84.1% | 1.35 | 0.6947045 | 81.9% | 75.0% | 0.66 | 0.2255004 |
| hCV22274307 | T | A | 80.5% | 72.5% | 0.64 | 0.1594207 | 81.8% | 85.4% | 1.30 | 0.7390766 | 85.0% | 90.0% | 1.59 | 0.7030736 | 81.3% | 78.9% | 0.87 | 0.3963096 |
| hCV22274307 | T | C | 69.2% | 77.8% | 1.57 | 0.006257 | 70.7% | 74.2% | 1.20 | 0.1086048 | 69.1% | 71.3% | 1.04 | 0.4469958 | 69.4% | 78.9% | 1.80 | 0.0464023 |
| hCV22274307 | T | O | 67.5% | 77.7% | 1.68 | 0.009554 | 70.1% | 75.0% | 1.28 | 0.0646705 | 74.1% | 72.7% | 0.93 | 0.5 | 68.1% | 77.8% | 1.64 | 0.184606 |
| hCV22274712 | G | A | 50.0% | 78.0% | 1.34 | 0.3876749 | 72.1% | 72.3% | 1.01 | 0.5 | 67.5% | 70.0% | 1.12 | 0.4236004 | 68.8% | 81.6% | 2.01 | 0.1089093 |
| hCV22274712 | G | C | 43.0% | 42.4% | 0.74 | 0.0389551 | 52.4% | 48.7% | 0.89 | 0.1941063 | 52.9% | 48.9% | 0.88 | 0.3178886 | 41.0% | 30.3% | 0.60 | 0.0543973 |
| hCV22274712 | G | O | 64.7% | 40.2% | 0.89 | 0.5448361 | 40.1% | 40.5% | 1.02 | 0.5310999 | 35.2% | 38.6% | 1.16 | 0.5831574 | 38.9% | 25.0% | 0.52 | 0.0989716 |
| hCV22274712 | G | O | 47.5% | 49.0% | 0.49 | 0.0084196 | 79.9% | 70.0% | 0.59 | 0.0359988 | 66.3% | 58.0% | 0.70 | 0.178439 | 45.8% | 36.8% | 0.69 | 0.2549187 |

TABLE 7-continued

| Marker | Risk allele | Strata | UCSF CT AF | UCSF CASE AF | UCSF OR | UCSF P_2tail | VCU CT AF | VCU CASE AF | VCU OR | VCU P_1tail | UIC CT AF | UIC CASE AF | UIC OR | UIC P_1tail | Stanford CT AF | Stanford CASE AF | Stanford OR | Stanford P_1tail |
|---|---|---|---|---|---|---|---|---|---|---|---|---|---|---|---|---|---|---|
| hCV2231920 | G | A | 71.6% | 75.2% | 1.21 | 0.2247586 | 76.2% | 77.9% | 1.14 | 0.1982516 | 79.9% | 79.8% | 1.06 | 0.4084657 | 76.6% | 67.1% | 0.61 | 0.9343178 |
| hCV2231920 | G | C | 66.4% | 75.0% | 1.52 | 0.0288903 | 68.7% | 74.7% | 1.34 | 0.0443199 | 73.1% | 70.5% | 0.88 | 0.5887956 | 76.4% | 58.3% | 0.43 | 0.9633293 |
| hCV2231920 | G | O | 62.7% | 75.6% | 0.65 | 0.1957481 | 92.9% | 86.2% | 0.48 | 0.0384883 | 83.8% | 88.0% | 1.42 | 0.6930522 | 77.1% | 76.3% | 0.96 | 0.5 |
| hCV2231945 | T | A | 53.7% | 60.7% | 1.33 | 0.0486449 | 50.4% | 55.8% | 1.23 | 0.0579431 | 47.0% | 48.9% | 1.06 | 0.4103812 | 50.8% | 53.9% | 1.19 | 0.2768125 |
| hCV2231945 | T | C | 55.3% | 63.8% | 1.42 | 0.0489136 | 53.8% | 58.6% | 1.22 | 0.108711 | 51.9% | 52.3% | 1.02 | 0.5 | 54.2% | 50.0% | 0.85 | 0.6555572 |
| hCV2231945 | T | O | 50.4% | 53.7% | 1.14 | 0.6149383 | 42.9% | 48.5% | 1.25 | 0.2012655 | 43.6% | 46.0% | 1.10 | 0.4280525 | 43.8% | 57.9% | 1.77 | 0.1387843 |
| hCV2351160 | G | A | 31.2% | 23.3% | 0.67 | 0.0167009 | 38.6% | 31.8% | 0.76 | 0.0275758 | 47.8% | 47.9% | 1.13 | 0.6665958 | 29.8% | 25.0% | 0.70 | 0.1323782 |
| hCV2351160 | G | C | 23.2% | 18.1% | 0.73 | 0.1532795 | 26.2% | 20.7% | 0.74 | 0.0519376 | 29.6% | 31.8% | 1.11 | 0.5854141 | 18.1% | 25.0% | 1.51 | 0.7744996 |
| hCV2351160 | G | O | 48.1% | 35.4% | 0.59 | 0.05596 | 66.2% | 60.8% | 0.79 | 0.1931171 | 58.8% | 62.0% | 1.15 | 0.5729245 | 50.0% | 26.3% | 0.36 | 0.0144927 |
| hCV2384392 | T | A | 7.0% | 3.4% | 0.46 | 0.0305408 | 8.0% | 5.6% | 0.67 | 0.0596828 | 2.2% | 4.3% | 2.07 | 0.8362451 | 9.6% | 3.9% | 0.42 | 0.0874284 |
| hCV2384392 | T | C | 6.6% | 4.3% | 0.63 | 0.28825 | 8.1% | 6.5% | 0.79 | 0.231934 | 1.9% | 0.0% | 0.40 | 0.5 | 12.9% | 8.3% | 0.62 | 0.3736625 |
| hCV2364392 | T | O | 7.8% | 1.2% | 0.15 | 0.0335213 | 7.8% | 3.1% | 0.38 | 0.0602507 | 2.5% | 8.0% | 3.39 | 0.8962428 | 6.3% | 0.0% | 0.17 | 0.1257182 |
| hCV2479345 | G | A | 39.8% | 47.0% | 1.34 | 0.0437608 | 38.2% | 43.6% | 1.23 | 0.0840699 | 39.0% | 41.5% | 1.11 | 0.3528926 | 46.0% | 48.7% | 1.17 | 0.2993821 |
| hCV2479345 | G | C | 44.1% | 54.3% | 1.50 | 0.0176633 | 44.8% | 50.6% | 1.26 | 0.072576 | 48.1% | 47.7% | 0.96 | 0.5 | 47.2% | 44.4% | 0.89 | 0.5802075 |
| hCV2479345 | G | O | 30.8% | 30.5% | 0.99 | 1 | 23.4% | 25.4% | 1.12 | 0.6092964 | 31.3% | 36.0% | 1.24 | 0.6490684 | 43.8% | 55.3% | 1.59 | 0.8073652 |
| hCV2600642 | C | A | 9.5% | 5.9% | 0.60 | 0.0692833 | 9.4% | 5.6% | 0.55 | 0.0082676 | 5.1% | 8.5% | 1.65 | 0.8233932 | 8.1% | 7.9% | 1.30 | 0.6753239 |
| hCV2600642 | C | C | 10.5% | 6.4% | 0.58 | 0.1115538 | 11.9% | 6.5% | 0.51 | 0.0085046 | 1.9% | 15.9% | 10.03 | 0.9895562 | 8.3% | 8.3% | 1.00 | 0.5 |
| hCV2600642 | C | O | 7.3% | 4.9% | 0.65 | 0.614311 | 3.9% | 3.1% | 0.78 | 0.3792678 | 7.5% | 2.0% | 0.25 | 0.1243315 | 4.2% | 7.9% | 1.97 | 0.6745676 |
| hCV2609481 | G | A | 77.3% | 85.9% | 1.83 | 0.0023178 | 73.6% | 80.0% | 1.45 | 0.0205478 | 61.8% | 64.9% | 0.98 | 0.5280967 | 83.1% | 92.1% | 3.04 | 0.0123415 |
| hCV2609481 | G | C | 88.6% | 91.0% | 1.29 | 0.415313 | 89.5% | 92.1% | 1.36 | 0.1418109 | 94.4% | 88.6% | 0.46 | 0.7694846 | 91.7% | 97.2% | 3.18 | 0.2102158 |
| hCV2609481 | G | O | 53.5% | 74.4% | 2.53 | 0.0008009 | 39.0% | 49.2% | 1.52 | 0.0460903 | 40.0% | 44.0% | 1.18 | 0.3579197 | 68.8% | 86.8% | 3.00 | 0.0356764 |
| hCV2639661 | G | A | 80.6% | 74.4% | 0.71 | 0.0362201 | 81.7% | 75.3% | 0.69 | 0.0108558 | 91.9% | 81.9% | 0.43 | 0.0190075 | 83.9% | 82.9% | 0.79 | 0.2748191 |
| hCV2639661 | G | C | 78.5% | 69.7% | 0.63 | 0.0170137 | 77.6% | 71.7% | 0.73 | 0.0392889 | 85.2% | 75.0% | 0.52 | 0.1521166 | 81.9% | 69.4% | 0.50 | 0.0749799 |
| hCV2639661 | G | O | 85.0% | 85.4% | 1.03 | 1 | 90.9% | 84.6% | 0.55 | 0.0392926 | 96.3% | 88.0% | 0.29 | 0.9568833 | 87.5% | 94.7% | 2.57 | 0.1467277 |
| hCV25741844 | T | A | 17.4% | 28.5% | 1.88 | 9.39E-05 | 17.9% | 21.8% | 1.25 | 0.083091 | 16.9% | 20.2% | 1.18 | 0.317384 | 18.5% | 23.7% | 1.37 | 0.1912076 |
| hCV25741844 | T | C | 18.9% | 28.2% | 1.68 | 0.0096562 | 23.3% | 24.0% | 1.04 | 0.4285581 | 22.2% | 25.0% | 1.17 | 0.406462 | 15.3% | 22.2% | 1.58 | 0.212713 |
| hCV25741844 | T | O | 14.2% | 29.3% | 2.49 | 0.0028723 | 5.8% | 16.2% | 3.10 | 0.0031024 | 13.8% | 16.0% | 1.19 | 0.4002202 | 22.9% | 26.3% | 1.20 | 0.4012361 |
| hCV25750908 | T | A | 8.4% | 7.1% | 0.86 | 0.5605308 | 10.9% | 9.0% | 0.85 | 0.2346491 | 13.2% | 13.8% | 1.23 | 0.6896759 | 8.9% | 9.2% | 0.95 | 0.4587783 |
| hCV25750908 | T | C | 4.3% | 6.9% | 1.67 | 0.1708664 | 2.6% | 5.3% | 2.09 | 0.0393616 | 1.9% | 6.8% | 3.88 | 0.161557 | 6.9% | 5.6% | 0.79 | 0.5 |
| hCV25750908 | T | O | 17.2% | 7.5% | 0.39 | 0.0320676 | 29.6% | 18.5% | 0.54 | 0.0184656 | 20.0% | 20.0% | 1.00 | 0.5 | 12.5% | 13.2% | 1.06 | 0.5 |
| hCV25766820 | G | A | 22.6% | 14.4% | 0.57 | 0.0045595 | 26.7% | 20.1% | 0.68 | 0.0143452 | 37.5% | 35.1% | 0.89 | 0.5731106 | 16.9% | 7.9% | 0.33 | 0.0123415 |
| hCV25766820 | G | C | 11.1% | 9.0% | 0.80 | 0.4925196 | 10.8% | 7.7% | 0.69 | 0.0934248 | 5.6% | 11.4% | 2.18 | 0.7694846 | 8.3% | 2.8% | 0.31 | 0.2102158 |
| hCV25766820 | G | O | 46.5% | 26.8% | 0.42 | 0.0019532 | 62.3% | 52.3% | 0.66 | 0.046492 | 58.8% | 56.0% | 0.89 | 0.4277638 | 31.3% | 13.2% | 0.33 | 0.0356764 |
| hCV25932158 | G | A | 65.1% | 50.4% | 0.55 | 2.56E-05 | 70.3% | 62.4% | 0.71 | 0.0083249 | 73.5% | 66.0% | 0.77 | 0.2080726 | 60.5% | 59.2% | 1.02 | 0.5340683 |
| hCV25932158 | G | C | 57.6% | 48.9% | 0.71 | 0.0413369 | 61.3% | 55.3% | 0.78 | 0.0602454 | 46.3% | 47.7% | 1.06 | 0.5 | 54.2% | 58.3% | 1.18 | 0.5812691 |
| hCV25932158 | G | O | 80.9% | 53.8% | 0.28 | 3.59E-06 | 90.3% | 80.9% | 0.45 | 0.0130339 | 91.3% | 82.0% | 0.44 | 0.0845615 | 66.7% | 63.2% | 0.86 | 0.4105438 |
| hCV25934437 | T | A | 4.5% | 1.5% | 0.32 | 0.0257952 | 6.8% | 3.2% | 0.46 | 0.00064385 | 3.7% | 4.3% | 1.27 | 0.6304882 | 5.6% | 3.9% | 0.47 | 0.1565498 |
| hCV25934437 | T | C | 3.9% | 0.0% | 0.06 | 0.003668 | 6.1% | 1.8% | 0.28 | 0.0025302 | 0.0% | 4.5% | 6.41 | 0.0995161 | 4.2% | 5.6% | 1.35 | 0.5 |
| hCV25934437 | T | O | 5.8% | 4.9% | 0.84 | 1 | 8.4% | 6.9% | 0.81 | 0.3317227 | 6.3% | 4.2% | 0.65 | 0.355304 | 8.3% | 0.0% | 0.13 | 0.0631947 |
| hCV25957240 | C | A | 56.6% | 68.1% | 1.65 | 0.000971 | 49.0% | 55.3% | 1.26 | 0.0441171 | 47.8% | 51.1% | 1.10 | 0.3693534 | 56.5% | 57.9% | 1.13 | 0.3449201 |
| hCV25957240 | C | C | 64.9% | 75.5% | 1.67 | 0.0086115 | 61.6% | 65.1% | 1.16 | 0.191056 | 61.1% | 70.5% | 1.52 | 0.198139 | 59.7% | 61.1% | 1.06 | 0.5 |
| hCV25957240 | C | O | 39.2% | 51.2% | 1.63 | 0.072136 | 20.8% | 30.0% | 1.63 | 0.0492322 | 37.5% | 34.0% | 0.86 | 0.644143 | 47.9% | 52.6% | 1.21 | 0.41414 |
| hCV25984261 | C | A | 2.8% | 0.7% | 0.27 | 0.0606644 | 3.6% | 1.1% | 0.30 | 0.0071254 | 5.1% | 4.3% | 0.89 | 0.4248321 | 2.4% | 0.0% | 0.23 | 0.0742667 |
| hCV25984261 | C | C | 1.7% | 0.0% | 15.00 | 0.1213053 | 1.5% | 0.0% | 0.09 | 0.0308162 | 1.9% | 0.0% | 0.40 | 0.5 | 1.4% | 0.0% | 0.65 | 0.5 |
| hCV25984261 | C | O | 5.1% | 2.5% | 0.48 | 0.5353937 | 8.4% | 3.8% | 0.43 | 0.0721086 | 7.5% | 8.0% | 1.07 | 0.5 | 4.2% | 0.0% | 0.24 | 0.2504788 |
| hCV27291900 | T | A | 59.8% | 53.7% | 0.78 | 0.0837914 | 63.5% | 57.5% | 0.78 | 0.0301542 | 60.3% | 58.5% | 0.90 | 0.6304882 | 50.0% | 64.5% | 1.76 | 0.9684743 |
| hCV27291900 | T | C | 59.1% | 53.7% | 0.80 | 0.23001474 | 63.4% | 56.5% | 0.75 | 0.0362308 | 64.8% | 63.6% | 0.95 | 0.354065 | 47.2% | 61.1% | 1.76 | 0.8893847 |
| hCV27291900 | C | O | 61.3% | 53.8% | 0.73 | 0.24221394 | 63.6% | 60.0% | 0.86 | 0.2709783 | 57.5% | 54.0% | 0.87 | 0.3597702 | 52.1% | 65.8% | 1.77 | 0.864224 |
| hCV27300005 | C | A | 56.4% | 63.8% | 1.35 | 0.0433036 | 48.2% | 58.3% | 1.52 | 0.0013325 | 45.6% | 50.0% | 1.12 | 0.3403385 | 57.3% | 55.3% | 0.94 | 0.5633889 |

TABLE 7-continued

| Marker | Risk allele | Strata | UCSF CT AF | UCSF CASE AF | UCSF OR | UCSF P_2tail | VCU CT AF | VCU CASE AF | VCU OR | VCU P_1tail | UIC CT AF | UIC CASE AF | UIC OR | UIC P_1tail | Stanford CT AF | Stanford CASE AF | Stanford OR | Stanford P_1tail |
|---|---|---|---|---|---|---|---|---|---|---|---|---|---|---|---|---|---|---|
| hCV2730005 | C | C | 63.1% | 71.8% | 1.49 | 0.0328832 | 59.6% | 70.1% | 1.59 | 0.0024796 | 59.3% | 68.2% | 1.47 | 0.2023347 | 65.3% | 72.2% | 1.38 | 0.2595746 |
| hCV2730005 | C | O | 42.2% | 45.0% | 1.12 | 0.6985873 | 22.4% | 27.7% | 1.33 | 0.1671833 | 38.3% | 34.0% | 0.91 | 0.5740851 | 47.9% | 36.8% | 0.63 | 0.8091472 |
| hCV27915384 | G | A | 21.1% | 18.7% | 0.85 | 0.3676827 | 21.5% | 19.7% | 0.89 | 0.2386044 | 28.7% | 23.4% | 0.73 | 0.1562376 | 17.1% | 17.1% | 0.97 | 0.4678049 |
| hCV27915384 | G | C | 23.7% | 17.6% | 0.89 | 0.0836062 | 23.5% | 18.0% | 0.84 | 0.0447214 | 35.2% | 22.7% | 0.54 | 0.0958734 | 19.4% | 19.4% | 1.00 | 0.5 |
| hCV27915384 | G | O | 15.6% | 21.3% | 1.46 | 0.2375873 | 16.9% | 23.8% | 1.54 | 0.0903206 | 25.0% | 24.0% | 0.95 | 0.5 | 16.7% | 15.8% | 0.94 | 0.5 |
| hCV2821340 | G | A | 45.5% | 41.4% | 0.86 | 0.2803912 | 52.2% | 40.6% | 0.63 | 0.0002727 | 55.1% | 58.5% | 1.28 | 0.815011 | 41.1% | 44.7% | 1.02 | 0.5309518 |
| hCV2821340 | G | C | 38.5% | 39.2% | 1.03 | 0.8618854 | 43.0% | 34.6% | 0.70 | 0.9661062 | 33.3% | 50.0% | 2.00 | 0.0519241 | 38.9% | 33.3% | 0.79 | 0.6629824 |
| hCV2821340 | G | O | 60.2% | 46.3% | 0.57 | 0.0381479 | 72.7% | 56.2% | 0.48 | 0.0020341 | 68.8% | 66.0% | 0.88 | 0.4237325 | 47.9% | 55.3% | 1.34 | 0.7386864 |
| hCV2917913 | C | A | 27.7% | 35.2% | 1.41 | 0.0225882 | 17.5% | 29.3% | 1.94 | 1.201E-05 | 19.1% | 16.0% | 0.74 | 0.7943893 | 22.6% | 22.4% | 1.05 | 0.4405787 |
| hCV2917913 | C | C | 30.6% | 38.3% | 1.41 | 0.0577141 | 21.2% | 34.0% | 1.91 | 0.00011 | 33.3% | 25.0% | 0.67 | 0.8074125 | 33.3% | 30.6% | 0.88 | 0.5849791 |
| hCV2917913 | C | O | 21.7% | 28.0% | 1.41 | 0.2341711 | 16.9% | 22.9% | 2.04 | 0.0258357 | 8.8% | 8.0% | 0.91 | 0.5 | 8.3% | 13.2% | 1.67 | 0.2500131 |
| hCV2944794 | G | A | 59.2% | 68.1% | 1.46 | 0.0109708 | 49.0% | 56.8% | 1.37 | 0.0142536 | 39.0% | 44.7% | 1.14 | 0.3270423 | 65.3% | 71.1% | 1.60 | 0.0705756 |
| hCV2944794 | G | C | 69.7% | 70.7% | 1.05 | 0.8536604 | 64.8% | 68.6% | 1.19 | 0.1461788 | 61.1% | 63.6% | 1.11 | 0.4182628 | 77.8% | 75.0% | 0.86 | 0.5947856 |
| hCV2944794 | G | O | 37.3% | 62.2% | 2.76 | 0.0001101 | 13.6% | 26.2% | 2.24 | 0.0050606 | 25.0% | 28.0% | 1.17 | 0.4188609 | 43.8% | 68.4% | 2.79 | 0.0148206 |
| hCV3113062 | T | A | 35.8% | 46.7% | 1.56 | 0.0018762 | 33.9% | 40.3% | 1.29 | 0.0319129 | 22.1% | 36.2% | 2.00 | 0.010507 | 43.5% | 43.4% | 1.03 | 0.4608034 |
| hCV3113062 | T | C | 40.1% | 52.7% | 1.66 | 0.0028426 | 42.2% | 48.2% | 1.28 | 0.0616715 | 25.9% | 43.2% | 2.17 | 0.0438725 | 47.2% | 44.4% | 0.89 | 0.5802075 |
| hCV3113062 | T | O | 26.9% | 32.9% | 1.33 | 0.3258496 | 15.6% | 20.0% | 1.35 | 0.1757042 | 18.8% | 30.0% | 1.86 | 0.0993233 | 37.5% | 42.1% | 1.21 | 0.4122427 |
| hCV3161768 | G | A | 53.0% | 52.2% | 0.98 | 0.8731043 | 61.4% | 57.7% | 0.88 | 0.1788584 | 72.8% | 55.3% | 0.48 | 0.00663 | 48.4% | 55.3% | 1.26 | 0.7859074 |
| hCV3161768 | G | C | 48.2% | 52.7% | 1.20 | 0.3081399 | 50.6% | 50.6% | 1.00 | 0.5 | 57.4% | 38.6% | 0.47 | 0.9642231 | 44.4% | 61.1% | 1.96 | 0.076287 |
| hCV3161768 | G | O | 63.1% | 51.2% | 0.61 | 0.0697402 | 85.7% | 76.2% | 0.53 | 0.0234812 | 82.5% | 70.0% | 0.49 | 0.0646164 | 56.3% | 50.0% | 0.78 | 0.3322375 |
| hCV3277068 | T | A | 34.0% | 38.9% | 1.24 | 0.1389596 | 34.3% | 38.0% | 1.21 | 0.0806907 | 41.9% | 35.1% | 0.80 | 0.7852856 | 29.0% | 30.3% | 0.97 | 0.5359563 |
| hCV3277068 | T | C | 31.6% | 43.1% | 1.64 | 0.0057287 | 25.9% | 35.8% | 1.60 | 0.0030636 | 31.5% | 31.8% | 1.02 | 0.5 | 22.2% | 30.6% | 1.54 | 0.1779704 |
| hCV3277068 | T | O | 38.8% | 29.3% | 0.65 | 0.1477092 | 53.2% | 43.8% | 0.69 | 0.0613871 | 47.5% | 38.0% | 0.68 | 0.1820258 | 39.6% | 28.9% | 0.62 | 0.1828419 |
| hCV335227 | T | A | 73.5% | 63.0% | 0.61 | 0.0008623 | 75.1% | 68.6% | 0.73 | 0.0140747 | 71.3% | 67.0% | 0.82 | 0.2355535 | 62.1% | 68.4% | 1.46 | 0.8861633 |
| hCV335227 | T | C | 75.0% | 64.9% | 0.62 | 0.0104322 | 73.0% | 67.8% | 0.78 | 0.0769509 | 59.3% | 79.5% | 2.67 | 0.9757051 | 63.9% | 69.4% | 1.28 | 0.6655937 |
| hCV335227 | T | O | 70.4% | 58.5% | 0.59 | 0.0578774 | 79.9% | 70.8% | 0.61 | 0.0476561 | 80.0% | 56.0% | 0.32 | 0.0026143 | 56.3% | 68.4% | 1.69 | 0.8635952 |
| hCV674099 | T | A | 71.1% | 73.9% | 1.15 | 0.3678151 | 71.3% | 74.4% | 1.17 | 0.1451128 | 72.1% | 63.8% | 0.66 | 0.9230096 | 73.4% | 71.1% | 0.93 | 0.5809078 |
| hCV674099 | T | C | 68.9% | 75.5% | 1.39 | 0.0944891 | 70.6% | 75.7% | 1.30 | 0.0711081 | 66.7% | 63.6% | 0.88 | 0.5838947 | 68.1% | 72.2% | 1.22 | 0.4124901 |
| hCV674099 | T | O | 75.8% | 70.0% | 0.75 | 0.3072016 | 72.7% | 70.8% | 0.91 | 0.3956819 | 77.5% | 64.0% | 0.52 | 0.054748 | 81.3% | 73.7% | 0.65 | 0.2206983 |
| hCV7241 | G | A | 24.0% | 31.7% | 1.48 | 0.0113192 | 19.9% | 27.6% | 1.52 | 0.0029709 | 22.1% | 18.1% | 0.75 | 0.8021384 | 26.6% | 35.5% | 1.41 | 0.1418487 |
| hCV7241 | G | C | 22.4% | 30.3% | 1.51 | 0.0382331 | 21.8% | 28.7% | 1.44 | 0.0212809 | 22.2% | 25.0% | 1.17 | 0.406462 | 20.8% | 33.3% | 1.90 | 0.0831837 |
| hCV7241 | G | O | 27.3% | 35.0% | 1.43 | 0.2057864 | 15.6% | 24.6% | 1.77 | 0.0360397 | 22.5% | 12.0% | 0.47 | 0.9168906 | 35.4% | 36.8% | 1.06 | 0.5 |
| hCV7450990 | A | A | 94.3% | 90.7% | 0.59 | 0.0391687 | 96.2% | 92.3% | 0.49 | 0.0061715 | 94.1% | 95.7% | 1.74 | 0.803836 | 96.0% | 97.4% | 2.76 | 0.8330422 |
| hCV7450990 | A | C | 93.0% | 90.9% | 0.75 | 0.339284 | 94.8% | 90.8% | 0.55 | 0.0268948 | 85.2% | 90.9% | 1.74 | 0.7306021 | 94.4% | 97.2% | 2.06 | 0.6685363 |
| hCV7450990 | A | O | 97.2.0% | 90.2% | 0.26 | 0.0129737 | 99.4% | 96.2% | 0.16 | 0.0483577 | 100.0% | 100.0% | 0.63 | 0.5 | 97.9% | 100.0% | 2.43 | 0.5 |
| hCV7466465 | T | A | 5.5% | 4.4% | 0.81 | 0.5215258 | 4.6% | 3.8% | 0.84 | 0.2959542 | 2.9% | 3.2% | 1.07 | 0.5379254 | 4.0% | 6.6% | 1.65 | 0.7958127 |
| hCV7466465 | T | C | 5.9% | 1.6% | 0.26 | 0.016351 | 4.7% | 2.4% | 0.50 | 0.0723592 | 3.7% | 4.0% | 0.60 | 0.5 | 2.8% | 11.1% | 4.38 | 0.9530579 |
| hCV7466465 | T | O | 4.6% | 11.0% | 2.55 | 0.0601169 | 4.5% | 7.7% | 1.75 | 0.159673 | 2.5% | 2.3% | 1.63 | 0.3191723 | 6.3% | 2.6% | 0.41 | 0.6867114 |
| hCV7882185 | G | A | 17.7% | 20.5% | 1.21 | 0.2830687 | 19.1% | 25.4% | 1.46 | 0.0072586 | 23.5% | 17.0% | 0.68 | 0.867871 | 15.3% | 18.4% | 0.99 | 0.5205225 |
| hCV7882185 | G | C | 16.0% | 21.8% | 1.47 | 0.0752876 | 17.4% | 23.7% | 1.47 | 0.0234103 | 20.4% | 20.5% | 1.01 | 0.5 | 5.6% | 16.7% | 3.40 | 0.0403162 |
| hCV7882185 | G | O | 21.2% | 17.5% | 0.79 | 0.528216 | 22.7% | 30.0% | 1.46 | 0.9116229 | 25.0% | 14.0% | 0.49 | 0.0912612 | 31.3% | 18.4% | 0.50 | 0.1089093 |
| hCV8761599 | A | A | 85.4% | 80.4% | 0.70 | 0.0515777 | 86.9% | 83.8% | 0.79 | 0.0966237 | 91.2% | 85.1% | 0.58 | 0.0951258 | 81.5% | 77.6% | 0.80 | 0.2765724 |
| hCV8761599 | A | O | 84.0% | 79.8% | 0.75 | 0.2158783 | 84.3% | 82.0% | 0.85 | 0.2078402 | 90.7% | 79.5% | 0.40 | 0.0750036 | 76.4% | 75.0% | 0.93 | 0.5 |
| hCV8853894 | T | A | 88.5% | 81.7% | 0.58 | 0.133722 | 88.5% | 88.2% | 0.59 | 0.1102352 | 91.3% | 90.0% | 0.86 | 0.5 | 87.5% | 81.9% | 0.63 | 0.2744206 |
| hCV8853894 | T | C | 87.3% | 93.3% | 2.02 | 0.0077809 | 83.3% | 88.2% | 1.46 | 0.0250629 | 81.6% | 85.1% | 1.15 | 0.3540533 | 91.1% | 91.9% | 1.15 | 0.3878615 |
| hCV8853894 | T | O | 92.6% | 95.2% | 1.58 | 0.3089678 | 90.4% | 93.8% | 1.60 | 0.0594588 | 96.3% | 90.9% | 0.38 | 0.7981506 | 94.4% | 88.2% | 0.44 | 0.8671687 |
| hCV8902345 | T | A | 76.2% | 89.0% | 2.54 | 0.0122277 | 67.5% | 73.8% | 1.36 | 0.1482903 | 72.5% | 80.0% | 1.52 | 0.2025485 | 85.4% | 94.7% | 3.07 | 0.1438192 |
| hCV8902345 | T | C | 55.2% | 43.7% | 0.62 | 0.0012654 | 56.6% | 51.3% | 0.83 | 0.0820887 | 63.2% | 60.6% | 0.95 | 0.4336586 | 48.4% | 55.3% | 1.12 | 0.6414179 |
| hCV8902345 | T | O | 46.9% | 34.6% | 0.60 | 0.003695 | 45.3% | 41.7% | 0.86 | 0.1772925 | 46.3% | 47.7% | 1.06 | 0.5 | 31.9% | 47.2% | 1.91 | 0.9290083 |

TABLE 7-continued

| Marker | Risk allele | Strata | UCSF | | | VCU | | | UIC | | | Stanford | | |
|---|---|---|---|---|---|---|---|---|---|---|---|---|---|---|
| | | | CT AF | CASE AF | OR | P_2tail | CT AF | CASE AF | OR | P_1tail | CT AF | CASE AF | OR | P_1tail | CT AF | CASE AF | OR | P_1tail |
| hCV8902345 | T | O | 72.7% | 64.6% | 0.69 | 0.1665025 | 81.8% | 76.2% | 0.71 | 0.1225128 | 75.0% | 72.0% | 0.86 | 0.4188609 | 75.0% | 63.2% | 0.57 | 0.1243548 |
| hCV8934089 | T | A | 30.1% | 21.1% | 0.62 | 0.0040434 | 28.5% | 24.4% | 0.81 | 0.0724643 | 28.7% | 28.7% | 1.07 | 0.5844489 | 30.6% | 19.7% | 0.51 | 0.0278846 |
| hCV8934089 | T | C | 31.8% | 21.3% | 0.58 | 0.0067997 | 28.8% | 24.0% | 0.78 | 0.0824734 | 25.9% | 27.3% | 1.07 | 0.5 | 31.9% | 19.4% | 0.51 | 0.1271185 |
| hCV8934089 | T | O | 26.5% | 20.7% | 0.72 | 0.3110768 | 27.9% | 25.4% | 0.88 | 0.3436329 | 28.8% | 30.0% | 1.06 | 0.5 | 31.3% | 18.4% | 0.50 | 0.1089093 |
| hCV9725216 | T | A | 84.5% | 92.6% | 2.29 | 0.0007704 | 82.9% | 89.5% | 1.73 | 0.0023665 | 77.9% | 85.1% | 1.56 | 0.112737 | 88.7% | 86.8% | 0.85 | 0.6413995 |
| hCV9725216 | T | C | 85.3% | 94.1% | 2.77 | 0.0012136 | 89.2% | 92.0% | 1.40 | 0.1167954 | 88.9% | 95.5% | 2.63 | 0.1449274 | 90.3% | 83.3% | 0.54 | 0.8242458 |
| hCV9725216 | T | O | 82.7% | 89.0% | 1.70 | 0.2236532 | 68.8% | 83.1% | 2.22 | 0.0029086 | 70.0% | 76.0% | 1.36 | 0.2736323 | 85.4% | 89.5% | 1.45 | 0.374111 |

Strata
O = other than Caucasian
A = all ethnic groups
C = Caucasian

SEQUENCE LISTING (34460 sequences)

SEQ ID NO: 1 - DNA, 7239 bp, Homo sapiens
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagca

SEQ ID NO: 2 - DNA, 4609 bp, Homo sapiens
gcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggcctcggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttattataggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagatatcaacattattatattttaaaatcacgctatggaaatatcacctgaattctgtcatttgtcagatttacagtacctttttttctttaacttttagcattaaataaaaataaaattgggagcactg

SEQ ID NO: 3 - DNA, 9589 bp, Homo sapiens
ccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 4 - DNA, 4069 bp, Homo sapiens
agaggcctgcgcgtgcggtctgcagttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaagaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggcgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtgcagtggtgcagtctgtagctcactgcagcctcaaactcctaggctcaggcgatcctcttgccctggcctcccatgtagctgcaactataggtgtgtgccactacacctggctaatgtttttagttttttagagatggagtcttgctctgttgcctaggctggtcttgaactcctgggctcagatgatcctcctgtcctcagcctcccaaaatgctgggagccaccaggcaccaggtgtgatctaccacacctgtctaaaaagtatgtatttttaaatttttttgtagagacaggatctcactatgttctccagctggtctcaagctcctggcctcggcctcctaaagtgctgggattacaagtgtgagccactgtgcctagtcactttaattgagatattggcaagtcaactgccatgcagagcccagggcactggttatattcagtaggaaactgaactcagcactcagaattttaaattaaatcaatgatcttcaagtatttgccactttcgagtacagctaattggataatctcaaaccctttagtgaaaatatcttaaatgcattgagaatattttctaattacctgtgtatgctacagtacagacattaattctataaacatgttcataggtcttccccctcgccccgcccgtcttctaagggcattttctgtttctttttagtgagttcatgaatgtttaacggttctggcgcaaagctttcttgcattctgagcataaaaataataaaacccacttatatttgcttg

SEQ ID NO: 5 - DNA, 5731 bp, Homo sapiens
agaggcctgcgcgtgcggtctgcagttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaataattggggtgagtataaagaggaattaggaacctgaatgtactccttatttaaagatatgcagtatcctttttgcaaatgatatccttttaaaagtaaaatttctaaactttatcttaatacctgtcacatattatagtcttgaattggaattttggttgaattacaaggaatttaagtatcagtcttcatcataaagaaatttaagatgaataaattgaagaaaaggctaaaataatttaagaaggaaattatatttctttgtttaaaaataacaggcaaaggtttatatgaagcttgtttgtaatacatcattattttctaatctgtgttttcctcccaaatttttatagcctaattcaaaggaattaggcttatcaaagctgtttttataattttgtattatgaaatgcctactataattagaataaaattgattgacttgaaagggaacccttttttccccattaattcaaaaccctttgacgagtaaaaatggccatatattgttatgtatagccgtgttaaaccatggcctcagattcactgcagctctcctcttaatatgtagacaagtagtacctcttttttgttgtaatgcttagttcatagtatgctcttatttgaattctttttgcctctacctaggaacttaatgaggttagactttatcaaatataagtatctggaaagagctactgattttatgttgttctatgaaccagttactactttagaataagttagcaaacaataaaaggattcctttagtagctcatgttctttgtttgcattagtgagtaatgaagtctagaaagaattgttttaaattgctttttttacagttccaatcatttttttatttgagaaaatttgaatctcaaaacaaaaattttcttcaatgtttaatacatcatatcaaggtattgtatttactttttttcactaatgagcagattttagaaaattctgtaactaccggggggcactgctattaacttttttcaattaatttggttaagccactatgcttcctcctcaggaaattaaaatgagtttaatttaatctgtgctttcctggcgtgaggaggtgtgggatttctgctacttaattattttgtggcccctagctctaagtccttgcacaagtgggatatattttgaatattgaccatctagcttgatgtctcatacaaaaagatattttttacacagtttttaatatttccatagtttattttcaaagggactgtaatgcatattacttattaaaagcattttttcccccaactttgatggggaaaagcatatcaacagatacctacttttgtagatggctataaaaattgttacccaaaaggctttcttagagcaaattgtctcttatgattattcctgcctgcctccatgggatctgtctttatattgttggagagaatagcaaacatccataatacatttttttttttttgtggatataacattcaggatagaattgtttgtcatttattgcttagattgatattttgtatacttagggattatgaaaaaagtttgtgttaatattgcattattaaagcacatgtttaaagataattattagattttaagttcacaatgcttcatgtattgtttattcttgtgattttatttttactttaggaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggcgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtgcagtggtgcagtctgtagctcactgcagcctcaaactcctaggctcaggcgatcctcttgccctggcctcccatgtagctgcaactataggtgtgtgccactacacctggctaatgtttttagttttttagagatggagtcttgctctgttgcctaggctggtcttgaactcctgggctcagatgatcctcctgtcctcagcctcccaaaatgctgggagccaccaggcaccaggtgtgatctaccacacctgtctaaaaagtatgtatttttaaatttttttgtagagacaggatctcactatgttctccagctggtctcaagctcctggcctcggcctcctaaagtgctgggattacaagtgtgagccactgtgcctagtcactttaattgagatattggcaagtcaactgccatgcagagcccagggcactggttatattcagtaggaaactgaactcagcactcagaattttaaattaaatcaatgatcttcaagtatttgccactttcgagtacagctaattggataatctcaaaccctttagtgaaaatatcttaaatgcattgagaatattttctaattacctgtgtatgctacagtacagacattaattctataaacatgttcataggtcttccccctcgccccgcccgtcttctaagggcattttctgtttctttttagtgagttcatgaatgtttaacggttctggcgcaaagctttcttgcattctgagcataaaaataataaaacccacttatatttgcttg

SEQ ID NO: 6 - DNA, 1388 bp, Homo sapiens
agaggcctgcgcgtgcggtctgcagttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaagaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagccaggtgtggtggttcgcgcctgaaatccagctgcttgggaggctgaggcaggaatcgcttgaatccgggaggcgaaggttgcagtgagccgagatcgtgccatttgcgctccagcctgggcaacaagagtgaaactccatctcaaaaaaacagaaacaaacaaataaaaaaactaagagacgaaactgaaataggaataatcaaagtgattttttttaaattacgctttgaaattctgctttaaaattaactttgagtatatgtaaatgataaccagaaaattcttttcaaatagaatgttaaagtagcatattactgttgaaagtggtgtattactgttgaattattttaaagct

SEQ ID NO: 7 - DNA, 2969 bp, Homo sapiens
aagcgcggagtgcgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacgttttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 8 - DNA, 2170 bp, Homo sapiens
aagcgcggagtgcgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagaggatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagtttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcacatatactaaatatgagacagggtaatgaaaacttggggaactggtaagtttttgcatgctacaagatttttttacttattaaaaaattattaaa

SEQ ID NO: 9 - DNA, 14614 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggagaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcaccgcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttga

SEQ ID NO: 10 - DNA, 14574 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcaccgcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggcagaggttgcagtgagttgagatcacgccactgcactccagcctgggcgacaagagtgaaactgtctcaaaaaacaaaaactgttacagtttatagagacatcctacatgtgtttcaaattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttga

SEQ ID NO: 11 - DNA, 14612 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcaccgcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttga

SEQ ID NO: 12 - DNA, 595 bp, Homo sapiens
cgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatac

SEQ ID NO: 13 - DNA, 719 bp, Homo sapiens
cgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacc

SEQ ID NO: 14 - DNA, 636 bp, Homo sapiens
cgcaccgcctcttcctcctggaagctatataatgatatcgcgtcacttccgctctctcttccacaggaggcctacacgccgccgcttgtgctgcagccatgtttactgtgtctgatttcttcccccgtactttttcaactagtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatac

SEQ ID NO: 15 - DNA, 835 bp, Homo sapiens
cgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctatggct

SEQ ID NO: 16 - DNA, 1100 bp, Homo sapiens
cgcaccgcctcttcctcctggaagctatataatgatatcgcgtcacttccgctctctcttccacaggaggcctacacgccgccgcttgtgctgcagccatggtaagactggaatccgtgccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatac

SEQ ID NO: 17 - DNA, 608 bp, Homo sapiens
gctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatac

SEQ ID NO: 18 - DNA, 1291 bp, Homo sapiens
cgcaccgcctcttcctcctggaagctatataatgatatcgcgtcacttccgctctctcttccacaggaggcctacacgccgccgcttgtgctgcagccatggtaagactggaatccgtgccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccaggctggagtgcagtggtgcgatctcggctcactgcaacctccacctcccaggttcaagcaattctcctgcctcagcctcctgagtagctgagattacaggtgtgcaccaccatgcccggctaatttttctgtatttttagtagagacggggtttcaccatgttggccaggctggtcttgaactcctgac

SEQ ID NO: 19 - DNA, 469 bp, Homo sapiens
gttcatctgacaccagctgcctccagcacaccactgaagttcaaccccaacaagatcaaagtcgtatacctgaggtgtaccttggataaagttgatgccatgtctgtgctggcccccaagattggccctctgggtatgtctgcaaaaaaggttggtgatgacactgccaaggcaaccggtgactggaagggtctaaggattatagtgaaactgaccattcagaacagacccagagtgaggtggtaccatctgccactgccagaagggtttctgcaaagccctcaaggaaccacaaagagatggaaagaaacagaaaaacattaaacacaatggaaatatcacttttgatgagattgtcaacattgcttcacagatgtggcactgatctttagccagagaactctctgaaaccactaaagagatcctgggaactgcccagtctgtgagctgcaatgctgatggctgccac

SEQ ID NO: 20 - DNA, 699 bp, Homo sapiens
atccagggaatagtgacagctgcaacacagtgtgatgggctactgtgctctgggactctcacccagagcaggcaaaggcacaagccctttactactggagaggtggcatcaggccacgatttctgctggaaaacagacgagctcattcaagggcgcctggaacaagagtgctggagtctggagcccaaggcttgtgggaggtcgggtcgccaaggttttggagttgtccttgcaacccaaattctctccagtatgcacaaaggaaacatgattaaccagcctccctaccagagggtgatctcagatgggtcccagaagcaggttctaatttacttaagtgatgagtctctccagttactcaatcctacaataccggccagtagatataattgcaaagcaggaaggggaatagtcgacatctggagcaaggcagatgcagccagaactgcctccagcacaccactgaagttcaaccccaacaagatcaaagtcgtatacctgaggtgtaccttggataaagttgatgccatgtctgtgctggcccccaagattggccctctgggtatgtctgcaaaaaagaagggtttctgcaaagccctcaaggaaccacaaagagatggaaagaaacagaaaaacattaaacacaatggaaatatcacttttgatgagattgtcaacattgcttcacagatgtggcac

SEQ ID NO: 21 - DNA, 3042 bp, Homo sapiens
attggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgttcttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagaagcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatccactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctgggggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgat

SEQ ID NO: 22 - DNA, 440 bp, Homo sapiens
ccttcaaagccagttatactttccaaaagggtcatgttttcatccagggcttgccagaaggcctggaagtgtcaagtctccagcagatctcccaggtacaaaatctgttggatcagctgcttttcttgatgcgcttggatgaccatgtgcttgcacagggtgaagctggtgtggcatgggttggtaaaggccttcagcgggatctgggtggtgaccgtggtctgaaagaaggctgggttgaactagtacagcttcaggacagtcaagctggcttctagatcacaggcattctccttggcctgtatctccacatagctccccagggaggccaggttctcagaattatacctgtggatattgttgagcaacttgcccacattcactctcaactactaaaacatcactatgactatggtcaccttccacaaccagtgctggaa

SEQ ID NO: 23 - DNA, 3436 bp, Homo sapiens
tcaatgcactgttcaaggatgtttgagagattttctgtcttgcctgaatacaaaacactgtagggaacctctttgtgcttgactttgcacacacacgggatcttcagggtgggtacatttaaaactgacaagtattgccaaattgccccccaacgtagtttttacaccccacctactactctcagtgaaaaatcaggccctttttattttaagggctaaattgctaatccctgtgtgaaaatgggtgttaacaaaataaaaaataaggaaaatatgcaggcttacccaattttgttatctatacattttacagtctctaatacttagcatagctcctttgggtgtctgcccaccacccttctttctgaacgtggggttccctgggctttccttgtttgacttcagacctggatctaatagggatctggaggtagaatcaagacgaatgttccctttggccttaggtgagtcctttgcatctctgaggccctgttgatgacatccagttctctagacctctgcccaaaccagagcaatccctcctcaaatatgctaagcagaaatgcagacaatataagacacactatatttatattttaggagtttacattaccttcccttctgtttggaaaccaacatctctcaaaattaggtatagttaacacagaataccccaaaataccaccattcttcataattccatttccttatttctggattctttcaagggtaaaaaccttgtttcattcatctttggggcagcatttgcctagtatgtggtaggcgcccagtagattttggataaactgacctgattttctgttaatattccaactggattatttctttctcctcttacagaatgaagatattcaaatgttattttaaacataccctacagcagaaagttttcatcctgtttttaaccctatggctgctctctttgttaaagcttctaaatgtgagacgactctttccgcaaaaagacatttacttggttgagtactccctaagtacctcgccttttgtaagaaacagatacactcatgttaaggatgaagtcaggtatgaagttaactgttcgggtatctatgaacaggagcctttggaaattggaaagagtctggaaataagaagaagggacatcattgacttggaggatgatgatgttgtggcaatgaccagtgattgtgacatttatcagactctaagaggttatgctcaaaagcttgtctcaaaggaggagaaaagcttcccaatagcctattctttggttgtccacaaagatgcaattatggttgaaaggcttatccatgctatatacaaccagcacaatatttactgcatccattatgatcgtaaggcacctgataccttcaaagttgccatgaacaatttagctaagtgcttctccaatattttcattgcttccaaattagaggctgtggaatatgcccacatttccagactccaggctgatttaaattgcttgtcggaccttctgaagtcttcaatccagtggaaatatgttatcaacttgtgtgggcaagattttcccctgaagtcaaattttgaattggtgtcagagttgaaaaaactcaatggagcaaatatgttggagacggtgaaacccccaaacagtaaattggaaagattcacttaccatcatgaacttagacgggtgccttatgaatatgtgaagctaccaataaggacaaacatctccaaggaagcacccccccataacattcagatatttgttggcagtgcttattttgttttaagtcaagcatttgttaaatatattttcaacaactccatcgttcaagacttttttgcctggtctaaagacacatactctcctgatgagcacttttgggctaccttgattcgggttccaggaatacctggggagatttccagatcagcccaggatgtgtctgatctgcagagtaagactcgccttgtcaagtggaattactatgaaggctttttctatcccagttgtactggatctcaccttcgaagcgtgtgtatttatggagctgcagaattaaggtggcttatcaaagatggacattggtttgctaataaatttgattctaaggtggaccctatcttgattaaatgcttggcagaaaagcttgaagaacagcagagagactggatcactttgccctcagaaaagttatttatggatagaaatctcactaccacatcatgatagtaaaatcaggatggaaataagagggtgcctgataaatggagtcagtgtggaattgaataccatactatgcccaatactgtttaaactcagtcctcccatattttaaaaggtgtccaaaattccatacacaagggaaagtgatctagcctttgatgttattagcctgcagttggctaggtttttttaatatttgtttttgcttgtaatctcactgagccaaatcagagatcttaaacattcagtcagtcatcaaacattattgagcacctaactatatgacaggcacttttttagagactgcggcttatcctcatcatagcaacctcggtatctttaagttctccacataacagtcaggattctactgaagaagcttttgaagtttgtggtaatcgtctgatcatataaaccacccatttcagagtagtgtttaagtactgtgaccaacactccacttgtctcttaactcagctttcaagacatttcttaaccatcagagcagaggaggaaagactcactacctcagaaaaatctcaaagaatagtccaatttcctgcttgccaaagcataatctgccttttggtgcattacttggtcaattcagggttgaggagactgttggggggcatttataatgtatgaaagttaaggaagggggtgaggatgtgggttgggacaggtagtacctaaagaggagcgaagggatttatacaacatttttatcatgttacaaaacagtatcatgaatggcctcctttttagttcaactgtttctttaaaatgcatttactgattaaaaataagaactgaccaatagctccaagtgtcacacaccagaacattaagcctaagtcctcaattcataagttatcattctagataagtttctttacaatggaatactttctatggaatcattataattctgttgtatggaactatcaagctaagagtcactaaactttcttcaaaaggttgtgtgaaatatgacagctttctaaattaatttgtatagtcatttaaaattttttcttctctggcaactgtccaactggaatccagatttaaagtgataaaagctctaagtttcttgcagtctttttctcagcttagttccagagagaaaaaagctaattttcctaaggacacagcaagaatattcattaaggatattttctaaaacccacacttgagaaaaccacccaatga

SEQ ID NO: 24 - DNA, 2644 bp, Homo sapiens
ggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttac

SEQ ID NO: 25 - DNA, 1524 bp, Homo sapiens
aaattctcagggtatcctctgatgtaggcctttcaggccttgaatccagtgggattgagaactttctaagagtggtgcggctcttgacaacatgtgggctccaccagcagcaatcatgggggatgggcccaccaagaaggtgggcaaccaggcccccctgcagacacaggccctccagactgcctctttaagggatggcccggcgaagcgggccgtgtgggtccgccatacgagttcagagccacaagaacctactgaatcaaaggcagccaaggagaggcccaagcaggaggtgaccaaagcagtggtcgtggacctgggcactggctactgtaaatgtggctttgccggcctgccaagacccacccacaagatctcaacaacggtgggcaagccctacatggagaccgccaagactggggataatcgcaaggagacattcgtggggcaggaactcaacaacacaaacgttcatctcaagctggttaaccctctgcgacatggcatcatcgtggactgggatacagtgcaggatatctgggaatatctcttccgacaagagatgaagatcgccccggaggagcatgcggtcttggtttcagacccgccactgagcccacacaccaacagagagaaatatgctgaaatgctgtttgaagccttcaacacccctgcaatgcacatcgcctaccagtcgcgcctgtccatgtactcctatggaaggacctccggcctggtggtggaggtgggccatggcgtgtcctacgtggtccccatctacgagggttatcctttgcccagcatcaccggaaggctggactacgcgggctctgacctgacagcctacctgctgggcctgctgaacagtgcggggaacgaattcacccaggaccagatgggcatcgtggaggacatcaagaagaaatgctgctttgtggccctggatcccattgaggagaagaaagtccctctcagtgagcatacgatccgctacgtgctgccggatgggaaggagattcagctgtgccaggaacggttcctctgctcggagatgttcttcaagccatctctcatcaagtccatgcagctgggcctccacacccaaaccgtgtcctgccttaacaagtgtgacatcgccctcaaacgggacctcatggggaacatcctgctctgcgggggcagcacgatgctcagtggcttccctaaccgtctgcagaaggagctaagcagcatgtgtcccaatgacaccccgcaggtaaacgtgctgcctgaaagagacagtgccgtgtggaccggtggctccatcctggcctcacttcagggtttccaaccattgtgggtccaccgctttgagtacgaggaacacgggcctttcttcctctacagaaggtgcttctgaacggcgacgaggatggacactgcactggcagtgcctaccctcgacagggtgagcgcactcctacacacagggggtggagccggcgcttattcctgtagcattaaacacccctcatatgcccctcc

SEQ ID NO: 26 - DNA, 1553 bp, Homo sapiens
atcactctgatgaacactgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccattattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggcaagtcttaaacactgaatatcacactcttcttatgactcttgttagcgattcaaggacataaatcttcattcttttctggcacagactacttaaatgggtctgttttcactttgctcatttttcttcaataaatctttttggcaagcaactgatt

SEQ ID NO: 27 - DNA, 1549 bp, Homo sapiens
atcactctgatgaacactgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccattattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactgatt

SEQ ID NO: 28 - DNA, 1118 bp, Homo sapiens
ggaagaggccccagcactgacctccgtgggggtggagatgaggaggatggaaagggtgtcttcctccagcatcttcctgaagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaagaagca

SEQ ID NO: 29 - DNA, 691 bp, Homo sapiens
ttccactcccacccgcccagctcgcgccacatacagtccctcaacgcgctcctgccgcgccgccccctccagacagcagcgttccggatcctagacgctttttgacggctggtcctccccagaaaatgcgccgtgtgagcccaaacatggtggggtttacgctggaccccgagcttgcaatctgtgcttgacaaaacacaaacatcgcgtgcctgtctcctccccctgagatcgagtagtaacagccactccaactctccacctccagcttctagcaccagggaccgcctccaccaccccatgtgccaagtggagttcgagctgcgcggccctcaagcagctgaagggtcccgtgagcgatcaggagaagctgctggtctacggcttgtacaaacaggccacccagggcgactgcgacatccccggccctccggcctcagacgtgagagccagggccaagtgggaggcttggagcgcgaaaaaaggggcgtccaagatggacgccatgaggggctacgcggccaaagtggaggagctgacgaagaaggaagtggggggcgtggagcgcgaacaaaggggcgtgcaagatggacgccatgaggggctacgcggccaaagtggaggagctgacgaagaaggaagtggggggcgtggagcgcgaacaaaggggcgtccaagatggacgccatga

SEQ ID NO: 30 - DNA, 1734 bp, Homo sapiens
gcgtaagacacttggagcgttaagacacttgctcaagaacgcagctgccgttcaggaaatgaggccgtcggggcgcccaggggtgctcggagggagcccgtttcccaaagcacgtgcgcgagccccgggcgcttccaagggctctaacttcacgtctgctccgtgttttcaagcgcagggggccggaggcggcaagacgcggcccaacgcgcggcgggacccggaccaccccccgccaaggccaccccgggacccctagacccgccccgacgcgggggacgtttcggtccgggcccgcgcgagcgtgcgcgacaggaggagacgcgacggggcagcaccgctctggtggcgcattgctggacgcagcccggggccggggagccgcggcacccacctaggtccatggcggcgacgccggcggctgcgcggggctaacgccccctcccctccgagaactcgaacgcggcgcgggacgcacggcacgatgggagacgcaggagccacggcggccgcgcttaggcctgctcacaacctccgcccggccccgcccacagcctccgccgcgcacgcgcagtcctcacgaacgagcgcgccaagcgcacagcgccgccttccggcagagccctcccaccagccctcaggtacccggacgtcgctcactagacccctccgcaccgtcccctgcccggcccctcttccggggtcccagcgggtcgggctcatgattccccggccccgcattcaccctcacccgcttctagcaccagggaccgcctccaccaccccatgtgccaagtggagttcgagctgcgcggccctcaagcagctgaagggtcccgtgagcgatcaggagaagctgctggtctacggcttgtacaaacaggccacccagggcgactgcgacatccccggccctccggcctcagacgtgagagccagggccaagtgggaggcttggagcgcgaaaaaaggggcgtccaagatggacgccatgaggggctacgcggccaaagtggaggagctgacgaagaaggaagtggggggcgtggagcgcgaacaaaggggcgtgcaagatggacgccatgaggggctacgcggccaaagtggaggagctgacgaagaaggaagggcgtccaagatggacgccatgaggggctacgcggccagagtgaggagatgaggaagaaggaggctggctgagggctcctcgggaatggaaagggcttcttagaccttgatggctgaaatgtcctgaaactgtcgcaagcttagccgagacatcaataaatcacttaaactgcatgagagtgactgctgttggaaaggagaaactcggtgactgagtgctggggaggcgtccaaatacacagactaactttttgtatggttttgggtggagttcccagctctcctattacaagagcgtatgtaggtatttggaaggacgagggggacagtgtgctgtggaaatgcccaagatctgagggcaggagaccattctccagtgacagcctcttgggaggttgaggccccagccccttatctcttcaaggctgatttactaataccccagcaccacagaggggagagggactctgtcctcctaaacactaaagtcaagtccaaaagcccccactggaacacagggcctacttgatgcgccagaacacagcagtttagaaacaatggagcagatggtgtcaaaatcccagccccagaaaggctcacctaagg

SEQ ID NO: 31 - DNA, 2504 bp, Homo sapiens
gcggtgggagtgggaaggaaggcggagggaaccatgcgaggttctgagaattgcggcgagggtcgcctcgagagacggtttctgagatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtatca

SEQ ID NO: 32 - DNA, 2568 bp, Homo sapiens
ccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtatca

SEQ ID NO: 33 - DNA, 2155 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatc

SEQ ID NO: 34 - DNA, 1296 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatc

SEQ ID NO: 35 - DNA, 2493 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacaccttatacacatggcctgaagatttttttccttctctttttttctgagatcacaccattgcactccagcctgggtgacaaaaggaaaacttcgtctcaac

SEQ ID NO: 36 - DNA, 2465 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctcagaccgccgcgcgtccctcttgtgcggttcaccacagttgtatttaagtgatcgtgtgag

SEQ ID NO: 37 - DNA, 2815 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacagtgagttgggggacagaggtctccaggggtagagggtgggcactggattgtggggaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctcagaccgccgcgcgtccctcttgtgcggttcaccacagttgtatttaagtgatcgtgtgag

SEQ ID NO: 38 - DNA, 3766 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 39 - DNA, 3340 bp, Homo sapiens
tagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccacaaaacgcatcagtttctgattcttggccatatcctaacatgcaagggccaagcaaaggcttcaaggctctgag

SEQ ID NO: 40 - DNA, 3072 bp, Homo sapiens
tagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccacaaaacgcatcagtttctgattcttggccatatcctaacatgcaagggccaagcaaaggcttcaaggctctgag

SEQ ID NO: 41 - DNA, 2543 bp, Homo sapiens
tcctgggtagaggccgggaagccacggttctgggacctggaggaaagatcctaggccccttcgactccaccggggccctgaggcggctggggtggggctgtctgggccccagtgggggagacctggggtcaccagctcccccaacccttcctcgcactcgctggtactatgccctgccaccacaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggtgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattct

SEQ ID NO: 42 - DNA, 3458 bp, Homo sapiens
tagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttc

SEQ ID NO: 43 - DNA, 2579 bp, Homo sapiens
ggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttataagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacagatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggactcctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacattaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgtcttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatttttattgcgctcaggttatgttccttttacctccttccttaataaagagaccacttgaaat

SEQ ID NO: 44 - DNA, 2873 bp, Homo sapiens
cactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttataagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacagatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggactcctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacattaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgtcttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatttttattgcgctcaggttatgttccttttacctccttccttaataaagagaccacttgaaat

SEQ ID NO: 45 - DNA, 4489 bp, Homo sapiens
gatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacaggtttgtatttagtgattctttaagtgtataaatattaaaaattgataatactattttgtttcccgttatttatttggaatgagtctaagttgattctttggctttctatttaataggcacctggtaaattctctttaattttatctcttagttctgtttttctgtgctacctcctagtagtgaaggagtcagtgcatagctctaaatttagacatctttctctgtagtcaccccagccaacgttaggatgttttcacaatgcagtgttatgaataatttctgttgtgtgttaatcacttttattaagaatatgactatgtaaaatttatttttgccaaatcataacttctaaaattcttatttgcatccctataccccagagagaaacttgattggtggtttctttgttaaaactgatgattgcatttccctctcatattccttcagaataaatgatgtttctcaggcttctgaagaactctgaaggcctaatttcactctgtaaaaagaaagtttggtttctgaattgggtcttttcaactcttggagaaattccttcaacaacccctggaaggaagaaacatttaatttcacttttgtatatccctgaggattgtactttgtatcaccttctttgaatagaagaaaatgtggagaaatctaacacatgctgacactctgtaggagtaacttaagtcttctgcttaaagaagcattatttagaaaagcaaaggtaatagttaacagtatttattttaagcatcgtatcacttttaaaaagtaaatttaggcctcagtttgttttatgcagatacacatatgtactaaaaagcaaaccacagcagctaaccttttatatcatttagactcagggagagcctagtattttatctattcacttaaggatgtgttcatgggttttggttagtggggaggagtaggcatgcttcagaaattgccttttgtatcaagtcaaaggttttatggctgttagagcatcttagctaattctccattctgtgtgtgtcataaactgcataattaggcctctgattaaataaatagctaggattgtcttcaatagtgtctgttaacttgaagattcattacagatatagctttttaattattggttttaggcctgcagataaacaatatagggaaaaatctatacagtaattacagcacactaggaacatctacattaggttggttttttttttttttttttactagttcttaattttagttattttgtggagtattagttttgaagtcttaccatcttgggatcaaatataagtaccatcattattagtggttataaatatcaacaagtattttcttctgctctatgagttttggattacacatttgtaaaataggttagtaaggttattttcaagattacagagagtacaaagtccctaccactagggcctgacatacagtaggtgctaaagtggtggtggttattaatattacacattttatttgtagaatcttccagaaagaaaaaatgtgtatttatcatattaaaaatggtcttatactccaatcatttttacaacatgtgcttcaaagtgatgtctttagtttttactgacattgtaagaaatatttctttgtcattttgtttcatagtgtcttctttatgtctctggaaagcaattctttgttggtcctaaacttgggggtagtgcgcgtgagcagtctttattttaaggatatagtttatatctaagaaaccatgtttctttccccctcgccccccactccctctgttggctgctagaaaacttgcaactaaaattgggatctgcttgtagcaagaatacagatacctctgggatagatttttatattaactacatttttctgctatattttttaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttataagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacagatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggactcctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacattaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgtcttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatttttattgcgctcaggttatgttccttttacctccttccttaataaagagaccacttgaaat

SEQ ID NO: 46 - DNA, 3088 bp, Homo sapiens
ggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggacgcatgaagagtaccaagcaagaggggagaggtaaagttccacaggagggagtcaggaagatcttcttagaggacggcactcttgagatgagtctcgaaatgagagacttggcctttgagagaaaaaaacagacttccagagcagtatgagcagaggatgaggtgaaactgctacccaagtagtgtgcaacagtgtgttttctgacagcgctatccttagagaatgttacattgatcttgcctacctgcaacaagaaagttcatttggatatatattttttgggtttttttgaatgcacgttttgtgctggacaacaagcaaatacaaaattttaaggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaggcctaatttcactctgtaaaaagaaagtttggtttctgaattgggtcttttcaactcttggagaaattccttcaacaacccctggaaggaagaaacatttaatttcacttttgtatatccctgaggattgtgagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcagggattattcacatttaaatattttcagttataagcagtgaggtcctaaagtgttacaagagtacagtctaccccatgttaggcatatctttgattatgtctttattccttatttcacaatgtatttggtgtgtaggggaggggggagaactaaatgagttttcagctttataaattgttaaacatttagacaaacagatatgtatgtatgaatgtacataaatatttttaactcctattgaccacgagtctcacttcagtttcccagttcctttcaacctctttctgatagatttcctctttcattacttttagtaaccatgttccttgtttccttttattcttccatctgaagccccactcttaaaaagttgcactgttccagtagttataatccacttgccctaggaacaagttagcactgaattttgggtggaataattagtttctgaaggcttgccaggactcctgagcaggtaggctctagagtcgggcagtccaataacttttttgcaataatggaaacgttctatgtgcagtccaatagggtagcaactggccaaatgaggcctactgattacttgaggtgtgccttgtataactgaatttatggtgctatttaaacaatttttttctaacgtgaaaaggataaaacattaaaaactcttgagaactataaagtgaacacctatatgcctacccctacctagattctatacttaacatcttttttactgtaatatctctattataataaatcttggtttttcacttaactggtgtaattggtgccaataaactactttttttgtagtgctatttaattttgattaaatttagatagccacgtgtctagcggctaccgtttggacagtatagctctagagcatggcttggtaacctgtttgccatggagcactagatggtccttttcactcctcaaaatgcatgcccattgtcttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatttttattgcgctcaggttatgttccttttacctccttccttaataaagagaccacttgaaat

SEQ ID NO: 47 - DNA, 6340 bp, Homo sapiens
gtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgac

SEQ ID NO: 48 - DNA, 1800 bp, Homo sapiens
gtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctgtctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggcaggcaaggaccagctgcccattctgagcccagggcagcctcttcaaccattattggtctaacctggcttgtcaggaaaccaagc

SEQ ID NO: 49 - DNA, 1780 bp, Homo sapiens
gtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatggtagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagcc

SEQ ID NO: 50 - DNA, 4107 bp, Homo sapiens
atgagtgttggccggaggaagctggccctgctctgggccctggctctcgctctggcctgcacccggcacacaggccatgcccaggatggctcctccgaatccagctacaagcaccaccctgccctctctcctatcgcccgggggcccagcggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggaggccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgaggaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgcgcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggaggttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggtgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggcacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccggggacacaggggctggctgtcagaagagctgccacacactggacatgacctgttacagcccccagtgtgtgcctggctgcgtgtgccccgacgggctggtggcggacggcgagggcggctgcatcactgcggaggactgcccctgcgtgcacaatgaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacacgctggtgcagaaccactgtggcgggaaagacagcacccaggactcctttcgtgttgtcaccgagaacgtcccctgcggcaccacagggaccacctgctccaaggccatcaagattttcctggggttcgagctgaagctaagccatgggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggccgcctacgcccaggcctgccatgaagtaggcctgtgtgtgtcctggcggaccccgagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacg

SEQ ID NO: 51 - DNA, 3332 bp, Homo sapiens
atgagtgttggccggaggaagctggccctgctctgggccctggctctcgctctggcctgcacccggcacacagcccccctcctctttctgcaggccatgcccaggatggctcctccgaatccagctacaagcaccaccctgccctctctcctatcgcccgggggcccagcggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggaggccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgaggaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgcgcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggaggttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggtgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggcacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccggggacacaggggctggctgtcagaagagctgccacacactggacatgacctgttacagcccccagtgtgtgcctggctgcgtgtgccccgacgggctggtggcggacggcgagggcggctgcatcactgcggaggactgcccctgcgtgcacaatgaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacacgctggtgcagaaccactgtggcgggaaagacagcacccaggactcctttcgtgttgtcaccgagaacgtcccctgcggcaccacagggaccacctgctccaaggccatcaagattttcctggggggcttcgagctgaagctaagccatgggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgcc

SEQ ID NO: 52 - DNA, 3396 bp, Homo sapiens
aggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacgaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccagctgattctgagcaaggtctttgagccgtgccacactgtgatccccccactgctgttctatgagggctgcgtctttgaccggtgccacatgacggacctggatgtggtgtgctccagcctggagctgtacgcggcactctgtgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctgccggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgccgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgcaa

SEQ ID NO: 53 - DNA, 3457 bp, Homo sapiens
aagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacgaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccagctgattctgagcaaggtctttgagccgtgccacactgtgatccccccactgctgttctatgagggctgcgtctttgaccggtgccacatgacggacctggatgtggtgtgctccagcctggagctgtacgcggcactctgtgcgtcccacgacatctgcatcgattggagaggccggaccggccacatgtgccgtgtggcttcccctccccacagcattcacctgcccagccgacaaggtgtaccagccctgcggcccgagcaacccctcctactgctacgggaatgacagcgccagcctcggggctctgccggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgccgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgc

SEQ ID NO: 54 - DNA, 3682 bp, Homo sapiens
accaccagcacaacctctgctcctacaaccagcacgacctctggtcctggaactactcccagccccgttcccaccaccagcacaacccctgtttcaaagaccagcacaagccatctttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacgaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccagctgattctgagcaaggtctttgagccgtgccacactgtgatccccccactgctgttctatgagggctgcgtctttgaccggtgccacatgacggacctggatgtggtgtgctccagcctggagctgtacgcggcactctgtgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctgccggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgccgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgcaa

SEQ ID NO: 55 - DNA, 621 bp, Homo sapiens
atgaaaggtttgatgtcagtctgtacacctgcacttggaggtgtggagtggggagcaggataccgccccaacctctccacctggctaaatcactcatcctttgagatgcagaagccaaagagatcctcagcacatacctccagaaagccagttactgcaggggatgcgtacggaccagccagccccatcacaaagtctctgcaaagctatgataacctcacggggagccggaccccacatcctgaattaaggggtgagcacatggccctggatggaccaatcggagatggcctcatgactcagtcacaagactttcatctgtacaatgggggtactgctggctcccaaggccagtgttggtggaatacagtgaatagagatctctttgggttttggaataacaaaaaagggactgtacatggatatttccaagctggaaccgaggcactttctagacgaaggcagccttatccccaggagatgattgaaaatgtaagaactattctgagcctgcaggccatagccaaagagacaacagcaaggaccaagattggcaaagtgacacatcctctccaaaagaagaacatgcagaacaaatcaaagaacacaaaccacgactga

SEQ ID NO: 56 - DNA, 732 bp, Homo sapiens
gtgagcaccagacacagtggccacctgaggaggaaacacacaacagctgagaatccacgggggatgcgtggccaggttagagcatcctggaatcaggcaggtacgaggagtccacgaagtggagaggtgatgcaaatctgcaggccttggggacaagagcacatcaaacccttgggggccgatgccttcagtattcctaattcctccatgttagaaaggtattttgggccagatctctttgggttttggaataacaaaaaagggactgtacatggatatttccaagctggaaccgaggcactttctagacgaaggcagccttatccccaggaggggtcagatgagccggcctggcaggcttgtttccctccaccagacaacagcaaggaccaagattggcaaagtgacacatcctctccaaaagaagaacatgcagaacaaatcaaagaacacaaaccacgactgacaaacacagccacactcgattttaaaaacttgacctgtgcagaagatgagtctccacggcctgcacagcacacagaattatttatccctatacccccatatattacacccccttccccggtctggagacagcctcctgaaaccgccctgggggccccagaagccctcaggtctccagggcttgtcactcaggcaccgaatacacttagcctaattggatattattccttcttcatgaagccaagcaggttgtcacctagttccctg

SEQ ID NO: 57 - DNA, 2807 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccgagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaaaatcggttgggtgcagcggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 58 - DNA, 1441 bp, Homo sapiens
cctctccatggtgcctctgctgggctcacatgtgaccaagcacagcaaaccatgaggcaggggatggtcttgaccatgagagcccttgcagcagctgccatgggcctcagctcctctccaagctgggaagagccctgaaaagccaaggtgtttttttttccctctttatttcagtgtaagtcccttgagctttcttgaaccagaagtgggctcattttgctttagagatttcaggtgggcttgtccttgtcctagcatcccagatccaccttctgggaagtcatcagattggaggtgatgttggcagcttttgtaaacaaagggtagtgttgtaagctgttgtgtctgcctatgtgtgtgtttgtgtacttggtctcatctctgcagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccgagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaaaatcggttgggtgcagcggcacacggct

SEQ ID NO: 59 - DNA, 7531 bp, Homo sapiens
cccaaagaggaaacatacccagcaaactcagttgattaaacatcaaacagacatacagacagatcccaaatcttctgttcaactggaaaggtcttttctctggagtcctgggaggcaagttatgggcagcactgcttctggccgcaccatgaagcctgagtctgcttgcgctctgcccagggccctgctctgtctgagcattgggcttctagctgcccccctccccacagcctgccgctgctaggaggtagaactttaggagtggtccttggcctgtttctacctgtcacctggctcacctcaccactcactcctcctccatcacagcaccccggccctccctgtccctggcctccctggctggggcatttgggggtccgctgggaggagtgcatcgctgaaggcttcttcctactctcctgcaccttctcctccttgagtcaaggcctccggatccacatggatagctgagatcttttcttggagaaagacgctttcctctttactccagtccctcacttccccacctgattttcctcctcttctgctggtcctgtctttttctactgcctctttattcaatttcttgcttgtgtgcccctctgggactctcttgtacactttcctccatctccactatctcaggatctgtgtgtgtgctgccttcctcctgtgtgctttctgtccccccatctctgtcttgtctttcccacttctattgccaaagggagagatcctctccgggctgttccctggcctgtctgctcctccgggctctgtcccagcagcgacaatgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaaggcctctcccacctcatgatgagtgaacaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcatatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttccc

SEQ ID NO: 60 - DNA, 3333 bp, Homo sapiens
atatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactac

SEQ ID NO: 61 - DNA, 4102 bp, Homo sapiens
atatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactac

SEQ ID NO: 62 - DNA, 6101 bp, Homo sapiens
caggactggagggcttgaggaatgtggtggtccctctcttcgttgtttctgccccctgaggttgtgctttctcagggatatgcactctgcacttccattcctgcagtgaaattaactcgagcttggcagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcatatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttccc

SEQ ID NO: 63 - DNA, 7504 bp, Homo sapiens
cccaaagaggaaacatacccagcaaactcagttgattaaacatcaaacagacatacagacagatcccaaatcttctgttcaactggaaaggtcttttctctggagtcctgggaggcaagttatgggcagcactgcttctggccgcaccatgaagcctgagtctgcttgcgctctgcccagggccctgctctgtctgagcattgggcttctagctgcccccctccccacagcctgccgctgctaggaggtagaactttaggagtggtccttggcctgtttctacctgtcacctggctcacctcaccactcactcctcctccatcacagcaccccggccctccctgtccctggcctccctggctggggcatttgggggtccgctgggaggagtgcatcgctgaaggcttcttcctactctcctgcaccttctcctccttgagtcaaggcctccggatccacatggatagctgagatcttttcttggagaaagacgctttcctctttactccagtccctcacttccccacctgattttcctcctcttctgctggtcctgtctttttctactgcctctttattcaatttcttgcttgtgtgcccctctgggactctcttgtacactttcctccatctccactatctcaggatctgtgtgtgtgctgccttcctcctgtgtgctttctgtccccccatctctgtcttgtctttcccacttctattgccaaagggagagatcctctccgggctgttccctggcctgtctgctcctccgggctctgtcccagcagcgacaatgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaaggcctctcccacctcatgatgagtgaacaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcatatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttccc

SEQ ID NO: 64 - DNA, 6128 bp, Homo sapiens
caggactggagggcttgaggaatgtggtggtccctctcttcgttgtttctgccccctgaggttgtgctttctcagggatatgcactctgcacttccattcctgcagtgaaattaactcgagcttggcagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcatatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttccc

SEQ ID NO: 65 - DNA, 4703 bp, Homo sapiens
atatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggtaggtcagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcatatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttccc

SEQ ID NO: 66 - DNA, 1643 bp, Homo sapiens
gtaaggaactgtagcttctctctgaaactgccgggaaagggaaaatctttttaaaatagacatcacacaaccaacagggtcccctaggttcaggcggggaggtgaggtcgagtgagaggaactgcttagcatacgcggggatgctcctcccatctcaccccaccgcgctaaggagaaggtcactttctctttaaatgcaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatgtatcctttccaaggaacccgtctatgtgtgtgtgttcctgagaggtcagtttcctcctctccagccctccaggagtattcacacacaaccaacttccccacctcttgcagtcctgtcagatttagccacagactgcccaaacccaggtacaggaatttagaatttccccaaaattagaagaaaagtggttgtaggggatgttttactactgatcaaaatctttgtgagtactttagctgacatcaatcatagcaaagcttgtccgatgtcctcctatcctttcagcattgaacaattatttttactaatttacactaccacctcacctggtcctcagtcagaaacagcgcgagtgcgcgcgcacacaccccagtgtgtctgacctgcacgatctggatgaagagagagggggtgagagagggcaggcggggactgcaacctcagtccacagacggcccgagaccctcgtccccggccctttgcacaggtgagggaactaaacctgtgcaagatgggagaccggggtgggaggaaggactggtccaaagcgccacgatccttgacgggcacagccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagc

SEQ ID NO: 67 - DNA, 3706 bp, Homo sapiens
cctcctccccatctcctccccttagtcccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcaggggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaa

SEQ ID NO: 68 - DNA, 3607 bp, Homo sapiens
cctcctccccatctcctccccttagtcccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcaggggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaa

SEQ ID NO: 69 - DNA, 4090 bp, Homo sapiens
aggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacatc

SEQ ID NO: 70 - DNA, 4350 bp, Homo sapiens
gcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggtaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaagggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagtaggatcatgtattcataagggatgaggcgggccacggcgatcccaggcctgagccgcggcctacccagtcagttcagagccaggccctccactaccggaacagagagcgctttgccacgatcaaatcagcatctttggtaagcaaacacccctctacccacgttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacatc

SEQ ID NO: 71 - DNA, 618 bp, Homo sapiens
gcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggtaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgag

SEQ ID NO: 72 - DNA, 4321 bp, Homo sapiens
gcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggtaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacatc

SEQ ID NO: 73 - DNA, 1180 bp, Homo sapiens
ctctccttctcctcctcctcctcctggggctcctaccccgcttcctctcggctctcccttatctctccggcacggtctctgactatctcttactcacggtgtctccccgcccctccctccgcagccgggggccaattccgcgagaggacaaattagtaaaaggcagagcagtccccggggaggggccagcgcggggggacatgcgggggctggggcgcggcggaagggcacgcggggaaacgagggggaggggcgggcaaggggtatttttaaccaggggcagcagctcgagttgcagggccggacggccgcaccccacgcgcgccctggcgggcattccggggcgattgtgcggcggcgccgcctcccgcagccccgggcccgcccggtccccagctcccctcgctccgcgcgaccgcagctgctcccgccgttcccagccagccccggcgcggggccgagattacctcgggctgcggcagctgctctgaggaggggccgggctggcagcgagcagacccctgccggacactcagcaaacggcagcctcaccccgcagggccgcgccactccccttccccaccccaccgccgcgtcccggctcagcgctccccggggaacgcagggggaccgggctcgctgcgtgaccttgggctctcagcccacccacctggaagcgcccatgtgtcaccttacccaggagagggcggcagaggctgcgagcaggacggcagccccctctccccacccccaggaccctgagatcctgcttcacgggctgcaagaagttggggggccaggattcggcgcggaggccgggggtgtgggtggggagactgcagagactcccgagacccccccaagtcagggcttttcgctggtctcgcagccccagcccagcagctgctgcagtcttgcatgttgtggatgcaagcattttgctgaggaaactgcatagcgttcccaggactctagggcccacgacccctcaaaagttaagagccgctgatctaatctaaccccactttcaccctcagttaacaaaagaggaaaactgaggcctgagagggtgtgacttgtttgataactatttaggatacaccatcaaaatttaactcaaactggattacacacctaaatataaatggccaaaccataaaacttttttttttaaaaatgg

SEQ ID NO: 74 - DNA, 634 bp, Homo sapiens
tgtgatttcatctggaattactggaatcacactgtctcctgtcagctttctctccctcccccggccctcctgctgatgagagacaggagcgatggatggtctgagttagcggggtcccggcaccacccagcgcaaaggcactgcactcacgcacgccatgcacatgctggctcacatcctccatcccatgcctcccctgtctccagcattccctctggaatacatcagcactgttgcctttgaggctggcctgcttgaatgcacacctgagctccggattcacagagtctcactctatcgccaggctggagtggtgcagtggcaagatctcggctcactacagtctccacctccagggttcaagccattctcttgcctcagcctcccaagtagctgggactacagttacacaccaccacatccagctaatttttgtatttttagtagagatggggtttcaccatgttgcccaggatggtctcgatctcctgacctcatgatctgcccaccttggcctcccaaagtgctgggattacaggcgtgagccaccgcacccagctgataaaaccatcttgaatgaccttcatcactgtgaacagtgatgcagtggctttataaactctagaatgtgcta

SEQ ID NO: 75 - DNA, 1054 bp, Homo sapiens
ctgtgcaattcgggtgagttccttcacccttctgagccatcccttggctcgtctggaaaatgcaaaaaaaaaaaaaagaaaaacaccaggtttttgcatcctcctggatgagggatataaagtgcctgacacagcatatgacagggatttgataaatgggggctgttagctgtcccattgtggatgtgagaatagcattctgctggctaaaaggcagacatgaatgttctagaacatggcgatcccggaatgtgcagtgaaggcaggaagaggaagaatgggcagggaagaacaagttgggatggaggaatgaactcttatctccagaagcagagctaagaatgcccacggagccttggcacatgacagcctccgctgagccaaatggcccaaagacttctgaatgagcttttgctgcaacaaaaaactttggatcattttgagagcctcccgtgaggtgccaatatgttgcagtaccttcccggccccgacactgatgtgattcatcgtaggtaacatatgaatacgctcaagctggccagcagcttgaaaaattggagtctatcaaattgaccttgagaaacacaggaaggtaatatttagtgacataccagatgaaatccttgcgcagagatgtgaggtgaggaaggacctgaagtgaagtagaccagcaaatatcaagggtcaaggagttgggggatgatatagagacgaagcctaacagatgtcaccagagcaagaaggccttacgacttcacatcctctctgcagggtatgaatggtgcaatggaatgaaatggtaactacagcttctggtgcaaaatttgagtttccataatcatcatcttgggaaaatgaggaacacaatataatggcatacacagagaacaagtgaaaagatgagagatgatgaacaggttgagtttcttcagcctacaacctatcaaatctaattttaaacatctggagccacgtgtattagttttgtttctgttccattttcctttttctgtgtccccgacggtgaatgattctgaataattcttagtctggg

SEQ ID NO: 76 - DNA, 543 bp, Homo sapiens
atgggccatggggtggagcagacagacttggagtttggaagccagatggaccaagcaaggagcctgactctgagctcaccagctgtgcaattcgggccaagatcacatgtgcaccatggagggcaaaagacttggcggtttcgaaccctatggtttaaaggaaagtcaatgttagaaaacataacatcaacacaagaattcctgactgtagttacggtacctccagtggtcacaatggactcgctcaagatactgtggccttgtgaccagccagaaatggacgaggtgccctcttatcccgagcagctcaaggaggaaaaaggcatcttctccatttcagatgtgtctttctgggtgaagggatctccatttgcgttaacatccctgaccccctctgccactcacttattcctgctcaagggagctgatccaacttatgttgtgaatgatagaaacttgctaccaatgaagcttgccctaactgtcagcgaagctattttcagcaatggtacaatttctccacctgaaagcaggctcatcaaa

SEQ ID NO: 77 - DNA, 5011 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccgggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatttcgcagtacttgtggcccactctctgcagagagtaaattgagagcccaagaagcagggcaaaaagagcctctcagactcggtcatagcagccctgccacctttacctggcatcaaatttatcttttagttttgaaactgcagctgacaaagacacagaccccagccatgccttttgggttcagtttttttgtttttgtcattctttgttatgccctccccctttaaaagaaaaaag

SEQ ID NO: 78 - DNA, 6322 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccgggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatgaccagggctatgtgtcaccttccctaagactcttaccttatctcatattttttgagaacttccagtgttacattatttaactgaatgtaattggcccatttgccttggtgggtgctggcctattagtgattagttaacaaaacacagcgtacagagagcacagaaaagcttaatgacctgctactgaaacacctagccagcagtgaaaatgttaattcttttcttgtttggaaagtatacacgtcttggaattttttccacgtgaaaaacaaatggcaatgaatgcatttaaagatattgccgacagatttttaaatctttttaccaggaaacttcctaaaggttaaat

SEQ ID NO: 79 - DNA, 7904 bp, Homo sapiens
ccaggcctggccagcagccccgagtgtgcttgtggtcggagccacttcacatgtgcagtgagtgctcttggagagtgtacctgcatccctgcccagtggcagtgtgatggagacaatgactgcggggaccacagcgatgaggatggatgtatactacctacctgttcccctcttgactttcactgtgacaatggcaagtgcatccgccgctcctgggtgtgtgacggggacaacgactgtgaggatgactcggatgagcaggactgtcccccccgggagtgtgaggaggacgagtttccctgccagaatggctactgcatccggagtctgtggcactgcgatggtgacaatgactgtggcgacaacagcgatgagcagtgtgacatgcgcaagtgctccgacaaggagttccgctgtagtgacggaagctgcattgctgagcattggtactgcgacggtgacaccgactgcaaagatggctccgatgaggagaactgtcccacctccatgtgtacggcagaacagttccgctgtcactcaggccgctgtgtccgcctgtcctggcgctgtgatggggaggacgactgtgcagacaacagcgatgaagagaactgtgagaatacaggaagcccccaatgtgccttggaccagttcctgtgttggaatgggcgctgcattgggcagaggaagctgtgcaacggggtcaacgactgtggtgacaacagcgacgaaagcccacagcagaattgccggccccggacgggtgaggagaactgcaatgttaacaacggtggctgtgcccagaagtgccagatggtgcggggggcagtgcagtgtacctgccacacaggctaccggctcacagaggatgggcacacgtgccaagatgtgaatgaatgtgccgaggaggggtattgcagccagggctgcaccaacagcgaaggggctttccaatgctggtgtgaaacaggctatgaactacggcccgaccggcgcagctgcaaggctctggggccagagcctgtgctgctgttcgccaatcgcatcgacatccggcaggtgctgccacaccgctctgagtacacactgctgcttaacaacctggagaatgccattgcccttgatttccaccaccgccgcgagcttgtcttctggtcagatgtcaccctggaccggatcctccgtgccaacctcaacggcagcaacgtggaggaggttgtgtctactgggctggagagcccagggggcctggctgtggattgggtccatgacaaactctactggaccgactcaggcacctcgaggattgaggtggccaatctggacggggcccaccggaaggtgttgctgtggcagaacctggagaagccccgggccattgccttgcatcccatggagggtaccatttactggacagactggggcaacaccccccgtattgaggcctccagcatggatggctctggacgccgcatcattgccgatacccatctcttctggcccaatggcctcaccatcgactatgccgggcgccgtatgtactgggtggatgctaagcaccatgtcatcgagagggccaatctggatgggagtcaccgtaaggctgtcattagccagggcctcccgcatcccttcgccatcacagtgtttgaagacagcctgtactggacagactggcacaccaagagcatcaatagcgctaacaaatttacggggaagaaccaggaaatcattcgcaacaaactccacttccctatggacatccacaccttgcacccccagcgccaacctgcagggaaaaaccgctgtggggacaacaacggaggctgcacgcacctgtgtctgcccagtggccagaactacacctgtgcctgccccactggcttccgcaagatcagcagccacgcctgtgcccagagtcttgacaagttcctgctttttgcccgaaggatggacatccgtcgaatcagctttgacacagaggacctgtctgatgatgtcatcccactggctgacgtgcgcagtgctgtggcccttgactgggactcccgggatgaccacgtgtactggacagatgtcagcactgataccatcagcagggccaagtgggatggaacaggacaggaggtggtagtggataccagtttggagagcccagctggcctggccattgattgggtcaccaacaaactgtactggacagatgcaggtacagaccggattgaagtagccaacacagatggcagcatgagaacagtactcatctgggagaaccttgatcgtcctcgggacatcgtggtggaacccatgggcgggtacatgtattggactgactggggtgcgagccccaagattgaacgagctggcatggatgcctcaggccgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggcatgaacagtttcctcatcttcgccaggaggatagacattcgcatggtctccctggacatcccttattttgctgatgtggtggtaccaatcaacattaccatgaagaacaccattgccgttggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgccttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatcaccttgcctggcttggagtcatgactaatcctgcacctgctctgtctggcagacccatgctgtggaaaacctgcttacagacatcacttttaagtcctttgtggatgtgggcacagtgaagagcaataaagagtgtgaggttcctgctggagttttcagctcatctggagaagacaggtcgaggccagagttccttgactgatgaaacctttatttcctctggaagaggaatggtagatgggtttcctcttgagtgctgactctgactggttggtagtggctgcctgagggcctattcgcacccaatgggaagaatgtcatatggctagtgacatctcttctgtgcactggaaggaaatgtcatggca

SEQ ID NO: 80 - DNA, 5571 bp, Homo sapiens
gcctggccagcagccccgagtgtgcttgtggtcggagccacttcacatgtgcagtgagtgctcttggagagtgtacctgcatccctgcccagtggcagtgtgatggagacaatgactgcggggaccacagcgatgaggatggatgtatactacctacctgttcccctcttgactttcactgtgacaatggcaagtgcatccgccgctcctgggtgtgtgacggggacaacgactgtgaggatgactcggatgagcaggactgtcccccccgggagtgtgaggaggacgagtttccctgccagaatggctactgcatccggagtctgtggcactgcgatggtgacaatgactgtggcgacaacagcgatgagcagtgtgacatgcgcaagtgctccgacaaggagttccgctgtagtgacggaagctgcattgctgagcattggtactgcgacggtgacaccgactgcaaagatggctccgatgaggagaactgtcccacctccatgtgtacggcagaacagttccgctgtcactcaggccgctgtgtccgcctgtcctggcgctgtgatggggaggacgactgtgcagacaacagcgatgaagagaactgtgagaatacaggaagcccccaatgtgccttggaccagttcctgtgttggaatgggcgctgcattgggcagaggaagctgtgcaacggggtcaacgactgtggtgacaacagcgacgaaagcccacagcagaattgccggccccggacgggtgaggagaactgcaatgttaacaacggtggctgtgcccagaagtgccagatggtgcggggggcagtgcagtgtacctgccacacaggctaccggctcacagaggatgggcacacgtgccaagatgtgaatgaatgtgccgaggaggggtattgcagccagggctgcaccaacagcgaaggggctttccaatgctggtgtgaaacaggctatgaactacggcccgaccggcgcagctgcaaggctctggggccagagcctgtgctgctgttcgccaatcgcatcgacatccggcaggtgctgccacaccgctctgagtacacactgctgcttaacaacctggagaatgccattgcccttgatttccaccaccgccgcgagcttgtcttctggtcagatgtcaccctggaccggatcctccgtgccaacctcaacggcagcaacgtggaggaggttgtgtctactgggctggagagcccagggggcctggctgtggattgggtccatgacaaactctactggaccgactcaggcacctcgaggattgaggtggccaatctggacggggcccaccggaaggtgttgctgtggcagaacctggagaagccccgggccattgccttgcatcccatggagggtaccatttactggacagactggggcaacaccccccgtattgaggcctccagcatggatggctctggacgccgcatcattgccgatacccatctcttctggcccaatggcctcaccatcgactatgccgggcgccgtatgtactgggtggatgctaagcaccatgtcatcgagagggccaatctggatgggagtcaccgtaaggctgtcattagccagggcctcccgcatcccttcgccatcacagtgtttgaagacagcctgtactggacagactggcacaccaagagcatcaatagcgctaacaaatttacggggaagaaccaggaaatcattcgcaacaaactccacttccctatggacatccacaccttgcacccccagcgccaacctgcagggaaaaaccgctgtggggacaacaacggaggctgcacgcacctgtgtctgcccagtggccagaactacacctgtgcctgccccactggcttccgcaagatcagcagccacgcctgtgcccagagtcttgacaagttcctgctttttgcccgaaggatggacatccgtcgaatcagctttgacacagaggacctgtctgatgatgtcatcccactggctgacgtgcgcagtgctgtggcccttgactgggactcccgggatgaccacgtgtactggacagatgtcagcactgataccatcagcagggccaagtgggatggaacaggacaggaggtggtagtggataccagtttggagagcccagctggcctggccattgattgggtcaccaacaaactgtactggacagatgcaggtacagaccggattgaagtagccaacacagatggcagcatgagaacagtactcatctgggagaaccttgatcgtcctcgggacatcgtggtggaacccatgggcgggtacatgtattggactgactggggtgcgagccccaagattgaacgagctggcatggatgcctcaggccgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggcatgaacagtttcctcatcttcgccaggaggatagacattcgcatggtctccctggacatcccttattttgctgatgtggtggtaccaatcaacattaccatgaagaacaccattgccgttggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgctgatggcacatcacgagaatttagacctggattttaccatgaacctcacatcttgtactccatcctgggccccctgaaactgcttat

SEQ ID NO: 81 - DNA, 1378 bp, Homo sapiens
gcggaggttgctgcaaagcatggtgaggcccaggtgaagatctggaggcactcctatgatgtcccaccacctccaatggagcccaaccatcctttctatagcaacatcagtaaggatcgcaggtatgcagacctcacagaagatctgctaccctcctgtgagagtctgaaggacactattgccagagctctgaccttctggaatgaagaaatagttccccagatcaaggaggggaaacgtgtactgattgcagcccatggcaacagcctccggggcattgccaagcatctggagggtctctctgaagaggctatcatggagctgaacctgccgactggtattcccattgtctatgaatgggacaagaacttgaagcctatcaagcccatgcagtttctgggggatgaagagatggtacgcaaagccatggaagctgtggctgcccagggcaaggccaagaagtgaaggccagcagggaggatactgtccccaggagcaccctccctgcctgtcttgtccctctgcccctcccacctgcacatgtcacactgaccccatctgtagacatcttgagttgtagctgcagatggggaccagtgactcccattttcattttagccattttgtctcctgcacccactcccttcatacaatctagtcagaatagcacttctagagcacaggttctcagtccaagctgtggaaaagctccccttatccaacagagtttaaaagtagtgacttgggtttttgcgagttgctttgtttactaaggacttgtggggaggaaccatgctaagccatgaccaatgaggagaagcaacagagcctgtctgtccccaggagccagtcctctgctcgtctgcagtcaggccactgcctgagggctctagtcattccagtggaagatgaatgtaacctgcatggtgatgtgacaactgtttcctccctgacgccagaggagctggctctagaaggttgggatcaatcctgaatttagttatgtgttacatttaatttaagaagtatagtatatataaataatacaaaacaataacccttctggggtttctcgtggcggttgaaatagtcccacatgtagtcatcagaaaataagccattcctcataccaatataggatcagctccttgacctctgaggggcaggagtgcttcctggtgtgggtattacaatcccttcctgccttgtttcgtgacagtgaaatgcctcttggtcctgtccaagtatgtctttcactgatttctgaatcatgttctacttgcttggccctgccacatgggtccagtgttcatctgagcataactgtactaaatctttttccagatcagtataataaaggagtgatgtgaaaaaaaaa

SEQ ID NO: 82 - DNA, 2118 bp, Homo sapiens
cagacctaaggcccagggcgcctgggggctggagcaagagaagcaaaaggagccaagggtgggggtttggggttcttgtgagggcccagccccaggaccccaggaccaggacacccaggagccccagggcccagccccagttcagaaggcaggggccttctgagggagcttaagggtcccacagcccaggacccccaccagggccagtggccagcgttgggggactcagcctcctcgtcgctcgtcctctctgtttctcccaccttttgccccctttctccttgcctgttcccacccgaggccccctcttggcctgcgtgagccggggcggcactgaactgggggccgatccgcctgggcggcggtgagaggcagggccgggagccgggccgctgggtttgggcctggcccgctcgccgcaatattgatggcccgtcagtgcggccctgattcctgtgctttcagttaaaaggtttctgttgttgtagcttatgcagttgctctgttgctatggaaacgtgacatcaaaatgacgtttcccgtttaaaagcttttaactaaattcctgcctgtcagatgtaggccccattttgagcgtggagctgccttcgagcgagcgtgagcggcgcctcccgcccatggtgcgtggggccgggccggggccctcgctgagcgcgctctctcaccccacaggcgcctccggcatggcggcggccgaggggcccggctacctcgtgtctccccaggcggagaagcaccggcgggcccgcaactggacggacgccgagatgcgcggcctcatgctggtctgggaggagttcttcgacgagctcaagcagaccaagcgcaacgccaaggtgtacgagaagatggccagcaagctcttcgagatgaccggcgagcgcaggctgggcgaggagatcaagatcaagatcaccaacatgaccttccagtacaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctcctacgaaggccgcttcgaggatgatcgctccgacagctcctccagcttactgtcccttaagttcaggtcggaggagcggccggtgaagaagcgcaaggtgcagagctgccacctgcagaagaagcagctgcggctgctggaggccatggtggaggagcagcgccggctgagccgcgccgtggaggagacctgccgcgaggtgcgccgtgtgctggaccagcagcacatcctgcaggtgcagagcctgcagctgcaggagcgcatgatgagtctgctggagaggatcatcaccaagtccagcgtctaggccagcaggcggcggcggcggcggggccgggcggctggtggtactgctcaggccacccagggcaggccactcaggccaggcgggcaagggggccgccccgcgagcggagaccgccttccacctggcctctggcaggatgtcccttctgaggggtattttgaggaacccccaggccctggggaccgtgaggctccagtctccagcatgaatgcccttcctcggacacaggccagggcctctggggttcactccgagtaagaacgtcctagagccactctccagtgtcgttactatcaatgatacttgacgtggctttgatattaaacgtatactttttcattcttgcctggaacgcacagtttgctgttgctggcttggtgaggatgccctgattgatggatcccgaaaatgaaagcagatggaaacgggttggggcaggctggagctgggggagctctctcctgaagggaaccctgtgtcctccctcaccaggacctctgcgtctctccttaaatggcctctgacgcctgatgaaaaccccagcgaccttccaggaggcttttattcagctctgtttggagcatcaggtgtttccactgcctccttagcaatgacactaataaaagtcgtaacacctgttcac

SEQ ID NO: 83 - DNA, 1997 bp, Homo sapiens
gagggaggggccgccggggaagaggaggaggaaggaaagaaagaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 84 - DNA, 1777 bp, Homo sapiens
gaaggaagtggcgggggaaggagtgtggtggtggtttaaaaaataagggaagccgaggcgagagagacgcagacgcagaggtcgagcgcaggccgaaagctgttcaccgttttctcgactccggggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 85 - DNA, 1695 bp, Homo sapiens
tgctaaaggagcacaatgcctgatgctgcaggagaaacattaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 86 - DNA, 1788 bp, Homo sapiens
gagggaggggccgccggggaagaggaggaggaaggaaagaaagaaagcgagggagggaaagaggaggaaggaagatgcgagaaggcagaggaggagggagggagggaaggagcgcggagcccggcccggaagctaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 87 - DNA, 4510 bp, Homo sapiens
tggcggggccggcggcggctgaagcgagagcgcgacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgccggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcccagccctgaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagcaggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctc

SEQ ID NO: 88 - DNA, 2062 bp, Homo sapiens
agcagtagctgctgccacagtagctgactggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaaggcaggggtaactcataggcttccctctgaccagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacc

SEQ ID NO: 89 - DNA, 2327 bp, Homo sapiens
agcagtagctgctgccacagtagctgactggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccggtgagcgccctctgcggggggcccgggctctggccctgggcactgctggcgggctgccctgcagagaccgggctgtgaaaagcacctcctggcggccccctggtttggcaggctaggcttcctcaggctctgaagccctgtcagctgggccaaagtggatgggaccagggtttgctctccctgcctgaggccgactggctttgtggagcagaaagcactgggccagggaaactgggcccgagggaggccagcccagacctcagtgcctggggtcggtgtcttgggttccagcttcggcttctggccagaaatccctcatcacacagcctggtactcaccttgtgtgtccctgggacgtaggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacc

SEQ ID NO: 90 - DNA, 2098 bp, Homo sapiens
agcagtagctgctgccacagtagctgactggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccgcttcggcttctggccagaaatccctcatcacacagcctggtactcaccttgtgtgtccctgggacgtaggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacc

SEQ ID NO: 91 - DNA, 2213 bp, Homo sapiens
ataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaa

SEQ ID NO: 92 - DNA, 2115 bp, Homo sapiens
atgtctgcagtcctcacccctggcctgttcctccccctcccagggcccctcccggcctctctacataaagccgggggtactgggcctcaggtcaggcctatggccatggccttcacagacctgctggatgctctgggcagcatgggccgcttccagctcaaccacacagccctgctgctgctgccctgcggcctgctggcctgccacaacttcctgcagaacttcacggccgctgtccccccccaccactgccggggccctgccaaccacactgaggcctccaccaacgactcgggggcctggctgagggccaccatacccctggaccagcttggggcccctgagccctgccggcgcttcaccaagcctcagtgggccctgctgagccccaactcctccatcccgggcgcggccacggagggctgcaaggacggctgggtctataaccgcagtgttttcccgtccaccatcgtgatggaggtcagaaggggctgggtgtgtgggggggctgctgccgaggcccagtctgaagcgcccatgtcttccctgcagtgggatctggtgtgtgaggcccgcactctccgagacctggcgcagtccgtctacatggccggggtgctggtgggggctgccgtgtttggcagcttggcagacaggctgggctgcaagggccccctggtctggtcctacctgcagctggcagcttcgggggccgccacagcgtatttcagctccttcagtgcctattgcgtcttccggttcctgatgggcatgaccttctctggcatcatcctcaactccgtctccctgcctcccgccagagttctggacctgggggacctgggctcccgggtagtggtggccctgctggctgtggttgtggagtggatgcccacacggggccggactgtggcgggtattttgctggggtattccttcaccctgggccagctcatcctggctggggtagcctacctgattcgcccctggcggtgcctgcagtttgccatctctgctcctttcctgatctttttcctctattcttggtggcttccagagtcatcccgctggctcctcctgcatggcaagtcccagttagctgtacagaatctgcagaaggtggctgcaatgaacgggaggaagcaggaaggggaaaggctgaccaaggaggtgatgagctcctacatccaaagcgagtttgcaagtgtctgcacctccaactcaatcttggacctcttccgaaccccggccatccgcaaggtcacatgctgtctcatggtgatttggtggggccattctcctatggagccgacccgacccgctcaaagctgccccgggaaccgcaggtttggttcgcgcacgccgggacttgccaaccgcacccgaaaaatcggggccatgtccaaatgtttcgcttcgctgccggcagggagccgcgccgggctcgctcctgggatcaactgcacagtcctggctttggggagcgggaggcggttctccaactctgtggcttactatggcctggccatggacctgcagaagtttgggctcagcctatacctggtgcaggccctgtttggaatcatcaacatcccggccatgctggtggccaccgccaccatgatttacgtgggccgccgtgccacggtggcctccttcctcatcctggccgggctcatggtgatcgccaacatgtttgtgccagaaggcacgcagatcctgtgcacagcccaggcagcgctgggcaaaggctgcctggccagctccttcatctgtgtgtacctgtttaccggcgagctgtaccccacggagatcaggcagatggggatgggctttgcctctgtccacgcccgcctcgggggcctgacggcgcccctggttaccacacttggggaatacagcaccatcctgccacccgtgagctttggggccaccgcaatcctggctgggctggccgtctgcttcctgaccgagacccgcaacatgcccctggtggagaccatcgcagccatggagaggagggtcaaagaaggctcttccaagaaacatgtagaagagaagagtgaagaaatttctcttcagcagctgagagcatctcccctcaaagagaccatc

SEQ ID NO: 93 - DNA, 3427 bp, Homo sapiens
gggaacggcgggagcagctgcggtcgcgcggagcgaggggagctggggaccgggcgggcccggggctgcgggaggcggcgccgccgcacaatcgccccggaatgcccgccagggcgcgcgtggggtgcggccgtccggccctgcaactcgagctgctgcccctggttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgat

SEQ ID NO: 94 - DNA, 3041 bp, Homo sapiens
cgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtcaggaggctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgat

SEQ ID NO: 95 - DNA, 3436 bp, Homo sapiens
gggaacggcgggagcagctgcggtcgcgcggagcgaggggagctggggaccgggcgggcccggggctgcgggaggcggcgccgccgcacaatcgccccggaatgcccgccagggcgcgcgtggggtgcggccgtccggccctgcaactcgagctgctgcccctggttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgagtcccaccagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgat

SEQ ID NO: 96 - DNA, 705 bp, Homo sapiens
ctccccttctcggtccagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatgtatccttccgtttgcttttgtctcctgagtggggttttgggtggagccccaagtcgacttgccggctcggcggccatctccccttctgcacagttgcccactctcccatgactggtctaagtgatggaatttccttcttaacggccacccagcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgtgagtgtccccaactgcctcccaccctccagctccgtcccaaacgcgtcccccaggagctggggggaatgacagatggg

SEQ ID NO: 97 - DNA, 3097 bp, Homo sapiens
cgggaaaggagaggtggccggcacgcctgggaactgggaaatccctttcctggattcactgggagcaccgggaggtggctgagaaccctacttctgtgaggggagcagtgaggcagggaaaccctaggtttggggatggataagcaggggcaggagagcagagcttgcaggcaggagcccaggttctagtcttgggaaggcctgggttctgagcaggcccatctgtccggcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgagtcccaccagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgat

SEQ ID NO: 98 - DNA, 2871 bp, Homo sapiens
cgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccaccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtg

SEQ ID NO: 99 - DNA, 2595 bp, Homo sapiens
ccccgccgcgggctctgcccagcaaggccccgcccattacagatgccacccattacaggctcctcccaccgcaggctccccccaccgcaggctcctcaaccacaggctcctcccaccatgggctcccccctcccccgcaacggcccctcccatcataggctcctcccaccgcgggctccccccaccacggcccctcccaccacaggctcctcccagagcaggctcctcccaccgcgggctcccctactacggcccctcccaccacagggtcttcccaccacaggctcctcccagcgcaggctcctcccaccgcgggctccccccaccacggcccctcccatcataggctcctcccactacaggctcctcccactacaggctcctcccaggctgcagcccacctgctcccctcccccgcctgccggctccggtcctcggcgtctgccctgtccccggggaccgcttttcgcggctcaagcgtgttcctgccctgagccggctctcgccccgtctcccgggcccgccgcgctctccccgcgccgtctccgtcccggtccctccctcccgccgcctccctgccctgccccccgccccgcccccgccgcggcgcgtttctcccccgcctcccgcgtccgtctttgcagcccgcgcctcccgcatgcccctcgcgtccccgtggcgcccgcccgcgcgcgtccgcgccccgccccctcccgcgcggttccgcattggcgtgctgcagggcgcggtgcactgcgccgccaccgtcaataggtggaccccctcccggagataaaaccgccggcgccggcgccgccagtccctctggctgagacctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggcgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggtgccgcgctccgaaccccgggcccgggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 100 - DNA, 1798 bp, Homo sapiens
cggtgcactgcgccgccaccgtcaataggtggaccccctcccggagataaaaccgccggcgccggcgccgccagtccctctggctgagacctcggctccggcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggcgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggtgccgcgctccgaaccccgggcccgggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 101 - DNA, 1748 bp, Homo sapiens
aatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggcgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggtgccgcgctccgaaccccgggcccgggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 102 - DNA, 9630 bp, Homo sapiens
ggccagaatcgaaactgagagctcctgggcaggctcggcagggcaggcagctccaggagggcttcgaaccgtggccaacagttccagtggactgcgtggacccgtgagctcaggagcctcagacgcctccctggagagccaagctggtgttcgaggtggcgcctccagggtccaccctgctgcccaacagccccgcggccaccagagggccgtccctggcccggctgtgtgccctggtggacctgtgtctgggctgctcccgctgcacccagcggctcaatgaaagcacctacgtcctccgtagggtggagcatgactgctcccgcgagatcctgctggcccgctttaagcaggccaccaagagcaaggtctggcgcgtggtgggctgccggcccaccttcccaaggcccctgtgctaccaagtctgccactactacagccctgggctcggctgccggcgccaccgaaaccggtgcacctttgcccgcagtcgcgaggaggccctggtctggaccttcgagcgtcagcacaacctccagcgcctatggctgaaggcggaggtgcagggcagcggggcccagggaggggcaggccgggcggccgacgccatccttacggagtttggcggccgcttcgagctgctttgctccctctgcttcaggcgctgtcccccatgcatctgtcgcgtggacccccaggggcagtgccctgagcacggagcctgcccctccctcctggcccacgtgagcgccgagggccgccgcaagcaacagtttgtggtggtgaggccgcggccccgggccggccagcctcctgcctactgcaggtttgtggggcgtgggcagccgtgctggcgtggggagtcccgctgccagtttgcacacagcgccgtggagatggctgtgtgggaggccgagcagctgggtggcctccagcggggggacctgctcacaccccctgcccctgatggcgacgggcgcacggccccccttggccagccccctggggcccagctgtactgcccggcctgcttggtcacctgccactctcaggaggccttcgagaaccactgcgcatcctcggagcacgcacagatggtggccttcgaccaggccctgccctgggagcaccgttccccacccccgggactctccaagttcgagctctgcccaaagcctgacctctgtgagtatggggacgcctgcaccaaggcacactcagcacaggagctgcaggagtgggtccggcgcacgcaggctgtggagctgcgggggcaggcggcctggcaggacgggctggtgccctaccaggagcggctgctggccgagtaccagcgcagcagcagtgaggtccttgtgctggcagagacccttgatggagtgcgtgtcacctgcaaccagcccctgatgtaccaggcccaggagaggaagacccagtacagctggacgtttgccgtccactctgaggagcccctgctacacgtggccctgctgaagcaggagccaggagccgacttctctctggtggctcccggcctcccgccaggccggctctacgcacggggtgagcgcttccgtgtgcccagctccactgccgacttccaggtgggagtgcgtgtgcaggccgcctcgttcggcacctttgagcaatgggtggtcttcgactttggccgccggccggtgctgctacaaaagctggggctgcagctgggccaggggcgtcgcccaggaccctgcaggaatctggcgctcggccaccctgaggagatggagcgctggcacactggcaaccgccacgtggtgcctggcgtggagcggacggccgagcagacggccctgatggccaagtacaagggccctgccctggccctggagttcaaccgcagcagcgtggcctcgggccccatctcgccaaccaactatcggcagaggatgcaccagtttctctatgaggaggaggcggctcagcagcagctggtggccaagctgaccctgcggggccaggtgttcctgaagacggcattgcagacgccagcgctgaacatgctcttcgcgcctccgggagcactgtacgcagaggtccccgtcccctcctccctgatgccagacacagaccagggcttcctgctgggccgggcggtcagcacagccctggtggcccctgtacctgcacccgacaatacggtgttcgaggtgcggctggagaggcgggccagctcagagcaggcgctgtggctgctgcttccggcccgctgctgcttggccctggggctgcagcctgaggcccgcctggtcctggaggtgcagttccagattgacccgatgaccttccgcctctggcaccaggcagtggacacactgcctgaggagcagctggtggtgcccgacttgcccacctgcgccctgcccagaccttggtctgtcccacccttgcggcgtggcaaccgcaagcaggagctggccgtggcgctcatcgcgggctggggccctggggatgggaggcgtgtccccccgctactcatctatggcccctttggcaccggcaagacctacacgctggccatggcctccctggaggtcatccggaggcctgaaaccaaggtgctcatctgcacacacaccaacagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctacgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcaacccagaccgggacatgtccatggcgtcctggctgaatctggctgagattgcgcaggtcgtcgagaaggtgcaggaggcctacaacacctggcccagctgctggggcggccgcgagcagaggtgcatctgtgtcgtttcccacggtgcccagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacaccgtcgccaggcccgagtccctgcagcaggcccggctgtacgagaacctgcccccggctgcgctacggaagctgctgcgcgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttg

SEQ ID NO: 103 - DNA, 7450 bp, Homo sapiens
ctcacctctgacagccagacaagggctgtgctcaggggcagctcggctgggcacacagtaggtgctttagcggacagcactgaggcccccagcaagaagcccatgagctcctccccctcccgcagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctacgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcaacccagaccgggacatgtccatggcgtcctggctgaatctggctgagattgcgcaggtcgtcgagaaggtgcaggaggcctacaacacctggcccagctgctggggcggccgcgagcagaggtgcatctgtgtcgtttcccacggtgcccaggtcagtgcactgaggcaggagctgaggaggcgggacctaggccaggtgtctgtcggcagttttgagatcctgccagggcggcagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacaccgtcgccaggcccgagtccctgcagcaggcccggctgtacgagaacctgcccccggctgcgctacggaagctgctgcgcgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagtgatccccagcaggttcctggagcggcagacctacaacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttg

SEQ ID NO: 104 - DNA, 3501 bp, Homo sapiens
cggtggcgaaggcggctttagtggcagcatgaagcgcaccccgactgccgaggaacgagagcgcgaagctaagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcac

SEQ ID NO: 105 - DNA, 5448 bp, Homo sapiens
cggcgctatagcaacggtagctagctgcagggccagtggcacggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggccccaagcggctgggacgagatgtggaaatggaagaaatgattgagcagctgcaagagaaagttcatgagcttgaaaaacaaaatgaaaccctcaaaaacagactgatttcagccaaacagcaacttcaaacccagggttacaggcaaactccatacaataatgtacaatctcgtattaacactgggcgtagaaaagcaaatgaaaatgctggtttacaggaatgccccaggaaaggtataaaattccaagatgcagatgtagcagaaactccacatcccatgtttacaaaatatggcaacagtttacttgaagaagccagaggagaaataagaaatttagaaaacgttattcagtcacaaagaggccagatagaggagttagagcacttggctgagatcctgaaaactcagttgaggagaaaagaaaatgaaattgagttatctcttcttcagcttcgagaacagcaagctacagatcaaaggtcaaatattcgggacaatgtagaaatgattaagcttcataaacagctagtagagaaaagcaatgctctttcagcaatggaaggaaaatttattcagcttcaagagaagcaaagaactctcagaatcagccacgatgctttgatggcaaatggggatgaattaaacatgcaacttaaagagcagcgtttaaaatgctgcagtcttgagaaacaattacattctatgaagttttctgaaagaagaatagaagagctgcaggatagaattaatgatttagaaaaggaacgggaacttttaaaggaaaactatgataaactttatgacagtgccttcagtgctgcccatgaagagcaatggaagttaaaggagcaacagctgaaagtgcagattgctcagctcgagactgccttgaagtctgacttaacagacaaaactgaaatccttgacagattaaaaactgaaagagatcaaaatgaaaaactcgttcaagagaatagagaactacagttacagtatctggaacaaaagcaacaacttgatgaacttaaaaaacgcataaaattgtacaaccaggagaatgatattaatgctgatgaattgagtgaagctctcctacttataaaggctcaaaaagaacaaaaaaatggagacctttcctttttagtgaaagtagatagtgaaattaataaagatctagaacgctctatgagagagctgcaagcaactcatgcagaaacggtgcaagagctggaaaagacaagaaacatgctaattatgcaacacaaaattaataaagattatcagatggaggttgaggcagtgacccgtaagatggaaaatttgcagcaagattatgaactcaaagtggaacagtatgttcatcttcttgatatcagggctgcacgtatccataaactagaagcccaattaaaggatattgcctatggcaccaagcagtacaaatttaaaccagaaatcatgccagatgactctgttgatgaatttgatgaaaccatccacttagaacgaggcgaaaatctatttgaaatccatatcaacaaagtaaccttttcttctgaagttttacaggcatctggagataaagagcctgtcactttctgtacctatgctttctatgattttgaactacagacaactcccgtagtgcgaggccttcatcccgaatataacttcacttctcaatatcttgttcatgttaatgacttatttttgcaatatattcagaagaatactatcacccttgaggtccaccaggcttatagcacagaatatgaaacaattgcagcatgtcaattaaaatttcacgaaattcttgaaaaaagcggccgaatattttgtacagcaagtttgattggaacaaaaggagacatcccaaattttggcacagtggaatactggttccgattaagagttcccatggatcaagcaattcgactttatcgagaaagggcaaaggctttggggtatataacatcaaattttaaggggccagagcatatgcagtcgttaagtcagcaagcacccaaaactgctcaactcagttctacagattccacagatggcaacttaaatgaacttcacattacaataagatgttgcaaccacctgcagtcccgagcaagccacctgcagccacacccatatgttgtgtacaagttttttgattttgcagaccatgatacagctatcattcccagtagcaatgatccacagtttgatgatcatatgtatttcccagtgccaatgaatatggacttggatcgataccttaagtcagagtctctgagtttttatgtttttgatgatagtgatacccaggagaatatttacataggaaaagtcaatgtgcctctgatttcgttggcacatgacaggtgtatctcaggaatatttgagttaacagaccatcaaaagcatcctgctggcaccatccatgttatattgaaatggaaatttgcttaccttccaccaagtggatcaataacaactgaagacttaggaaatttcattcgcagcgaagagccagaagttgttcaaagacttcctccagcatcctctgttagcacactagttttagcaccaagacctaaaccaagacaacgtttaacacctgtagataagaaggtatctttcgtggatatcatgccacatcagagtgatgtttcacaagaaggcagtgtagatgaggtaaaagagaatactgagaaaatgcagcaaggaaaagatgatgtgtctttactatctgaaggtcagcttgcagaacaaagcttggcatcttctgaagatgaaacagaaataacagaggacttggaaccagaagttgaagaggacatgtcagcttctgacagtgatgactgtattattccaggtcctatctccaagaatatcaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatgtgatctacgtggataaagaaaacaacaaagcaaagagagacatcttaaaagctatactacaaaaacaagagatgcctaatagaagccttcgcttcaccgtggtcagtgaccctccagaggacgagcaggacctggagtgtgaggacattggcgtggctcacgtcgaccttgccgacatgtttcaggaagggagggacctcattgagcaaaatatcgatgtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctatcaattaaatataaagaatgaaacttagcaccaacttattcaatgactgcaagttttttgtctttctttcttaaaagttcattctatttgtattattttcatacatttgtaatggtgacccagggatgtatatataaaaaggagatagttatatagatagatgtgaaatttacacgttgaaaacttagtatatgacacagaaagaaattatgaaaagtataactcaaattctgatatgcttagttagacgtgaaaggagtatctttttatcattttttaaatttacatcaagccagtacagtgccagggtgtatctgggtaaccagatcctcgaaaagcagctctgaaagttaattttctagcttttacccaatctcactgaaggatttaattgatatttttaatggagctgtgaatcaatgctgcaaaggaattgtctctagaggtctaggatataatgcatttcattttttaatttacttttttatttgtcattttcttcaaaggatttttataggctgtgggttttcactgtttgcaaacaggctatgttccttcttaagcatatgtaaagtattcagggagataagtaatttattaaaatctacctaatttgccgtgatatattaaatctctgcttcagtgatcacagaccatttcatttagagaattaggcattccctctttgtgtgattaaagctctggaaaatgagttctttgctcctatttgtgaacattcaaagcctgctaatggcaagaagatggaatagattatgagacaattcattacagttcaatagaaaaaaaaagcagctataatgcaaaaatgcaagtatgaatatctgcatatagtttgaaccatctgtgctctaatggcttcaataatgactctcgtctttagaaggctttgaaatgacatccgtacaatattaatttgttgatgtacattgtgggaccagtagagtatgatctgaccacagaaatctataaattctgtctataccactgggcctccctgtcctggggcctgccatctccgagaagaatcttgctctcatccaactctgcaaatcttcataacaactcgttcctctggaaccttctgg

SEQ ID NO: 106 - DNA, 2460 bp, Homo sapiens
aaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaa

SEQ ID NO: 107 - DNA, 2428 bp, Homo sapiens
gacctaacagcaccctgggtggaaacctcttcagcatttgcttggaatcagtaagctaaaaacaaaatcaaccgggaccccagcttttcagaactgcagggaaacagccatcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaa

SEQ ID NO: 108 - DNA, 2786 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctggggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaatt

SEQ ID NO: 109 - DNA, 1481 bp, Homo sapiens
attgtcagctcctgattctgcagaaaacacgaaactgagctgtacaaagatgctgatgaggggctgcagcatgcaattcacttcaccagcagtcactaagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaactattttttctttaattagggctggaataggaagccagtgtctcaaccatagtattg

SEQ ID NO: 110 - DNA, 2537 bp, Homo sapiens
ccggcccctgagagctggcactgcgactcgagacagcggcccggcaggacagctccagactgttttattatacagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaatt

SEQ ID NO: 111 - DNA, 2773 bp, Homo sapiens
tttccccacctgagcctggatcggctgaacctgggagtgcctcccctgacccgctctggcaacagcggcagtccaggccccgcccctcgcgactctgtctcctcccgccccagaccacgcccaccacacctccctggccccgcctttacctccccgccccgacctcgactccgccccacgcccaggccccgcccactgcccgggcgcctcttcccctccccccaggttcctgtccctcacccttcccccttctccaaccgccaacggccgcatgcgcatgaggcccggcccacgccccatcccgctcgatccacgatgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcagggcaggggagggcacagcaggccctgcgaagggcagagcggggcaggggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaa

SEQ ID NO: 112 - DNA, 2372 bp, Homo sapiens
gtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagaagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttc

SEQ ID NO: 113 - DNA, 2575 bp, Homo sapiens
tttccccacctgagcctggatcggctgaacctgggagtgcctcccctgacccgctctggcaacagcggcagtccaggccccgcccctcgcgactctgtctcctcccgccccagaccacgcccaccacacctccctggccccgcctttacctccccgccccgacctcgactccgccccacgcccaggccccgcccactgcccgggcgcctcttcccctccccccaggttcctgtccctcacccttcccccttctccaaccgccaacggccgcatgcgcatgaggcccggcccacgccccatcccgctcgatccacgatgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatgcttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcagggcaggggagggcacagcaggccctgcgaagggcagagcggggcaggggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaa

SEQ ID NO: 114 - DNA, 5135 bp, Homo sapiens
atggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacag

SEQ ID NO: 115 - DNA, 5099 bp, Homo sapiens
atggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacag

SEQ ID NO: 116 - DNA, 5506 bp, Homo sapiens
ctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaa

SEQ ID NO: 117 - DNA, 5626 bp, Homo sapiens
ctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaa

SEQ ID NO: 118 - DNA, 5339 bp, Homo sapiens
ctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaa

SEQ ID NO: 119 - DNA, 5459 bp, Homo sapiens
ctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaa

SEQ ID NO: 120 - DNA, 1459 bp, Homo sapiens
ctgcctttcatgttatagcccctaagggatccaggacccgaaaggccagcttctccctcattttgaaatcagttttctccacctgcaccactgcatagcacagatacagaaaccatcctatttcaggatttgaatgcaaaacttaccttcttactctaaagatgaatgatcagggagagatttattcaaccctgagatttttgcagtctccttcagagtcacagaatagattaaggcctgatgatactcaaaggcctgggaaaactgatgacaaagaattttcagtgccctggcacctcattgcagtgactcttgggatcctctgtttacttcttctgatgatagtcacagtgttggtgacaaatatctttcagtgtattcaagaaaaacatcaacggcaggaaattctaagaaactgtagtgaaaagtacatcatgcaaaatgacaactacttaaaagagcagattttgacaaataagactttaaaatatgacgttctcaaaaatagctttcagcagaaaaaggaactggattcacgccttatacaaaagaacagatgtcatagagaaaatgagatcgtttttaaagttttgcaaaatacaggcaaattctctgaagaccacgggtcctgttgtggagtaaactgttattattttaccatgcagaagaaagactggaagggatgtaaacagacttgtcaacattgtagatcatcccttttgaagatagatgacaaagatgaactcgtattttacattcacttttattctcttggactctgtttctcaatgttggacctaagatattgaagacaggctggagcccagagccttcattcaatctcagatttatgaaaataattactggattggattatcatatgatgaaagggaaagtaagtggaaatggattgataatggcacatctcctggaattaattctacaataatgcgtttttcttctgggagaggagaatgtgcatttttgacctcaacaagaatggcaactattgattgcattcaaacgtacaattgtatctgtgggaagagaatagactctattttctctgattcggtgtgcgccaagaagaaaaggtgaaaatggaatgttttctttttttgtttcccataataatttctgattataaatcattgcttttaactgtgggacttagttaattcttcaaaagataaagatgaacaggaagaaaaagaaaattattttggactatgactttaaagatcagatgccatctttcttcctggagaagaggagattttctcttttgagagtggttgttccttcctttaatgtccctgaggaattattcattctttctaattctcagaactacctatacaaccagttagagaactctgatattatatcctgggtcttttttcttatcaataggataaatcattccagcatcttctggttttgaaagcagttgtgaact

SEQ ID NO: 121 - DNA, 1377 bp, Homo sapiens
ctgcctttcatgttatagcccctaagggatccaggacccgaaaggccagcttctccctcattttgaaatcagttttctccacctgcaccactgcatagcacagatacagaaaccatcctatttcaggatttgaatgcaaaacttaccttcttactctaaagatgaatgatcagggagagatttattcaaccctgagatttttgcagtctccttcagagtcacagaatagattaaggcctgatgatactcaaaggcctgggaaaactgatgacaaagaattttcagtgccctggcacctcattgcagtgactcttgggatcctctgtttacttcttctgatgatagtcacagtgttggtgacaaatatctttcagtgtattcaagaaaaacatcaacggcaggaaattctaagaaactgtagtgaaaagtacatcatgcaaaatgacaactacttaaaagagcagattttgacaaataagactttaaaatatgacgttctcaaaaatagctttcagcagaaaaaggaactggattcacgccttatacaaaagaacagatgtcatagagaaaatgagatcgtttttaaagttttgcaaaatacaggcaaattctctgaagaccacgggtcctgttgtggagtaaactgttattattttaccatgcagaagaaagactggaagggatgtaaacagacttgtcaacattgtagatcatcccttttgaagatagatgacaaagatgaactcgccttcattcaatctcagatttatgaaaataattactggattggattatcatatgatgaaagggaaagtaagtggaaatggattgataatggcacatctcctggaattaattctacaataatgcgtttttcttctgggagaggagaatgtgcatttttgacctcaacaagaatggcaactattgattgcattcaaacgtacaattgtatctgtgggaagagaatagactctattttctctgattcggtgtgcgccaagaagaaaaggtgaaaatggaatgttttctttttttgtttcccataataatttctgattataaatcattgcttttaactgtgggacttagttaattcttcaaaagataaagatgaacaggaagaaaaagaaaattattttggactatgactttaaagatcagatgccatctttcttcctggagaagaggagattttctcttttgagagtggttgttccttcctttaatgtccctgaggaattattcattctttctaattctcagaactacctatacaaccagttagagaactctgatattatatcctgggtcttttttcttatcaataggataaatcattccagcatcttctggttttgaaagcagttgtgaact

SEQ ID NO: 122 - DNA, 1902 bp, Homo sapiens
ctgcctttcatgttatagcccctaagggatccaggacccgaaaggccagcttctccctcattttgaaatcagttttctccacctgcaccactgcatagcacagatacagaaaccatcctatttcaggatttgaatgcaaaacttaccttcttactctaaagatgaatgatcagggagagatttattcaaccctgagatttttgcagtctccttcagagtcacagaatagattaaggcctgatgatactcaaaggcctgggaaaactgatgacaaagaattttcagtgccctggcacctcattgcagtgactcttgggatcctctgtttacttcttctgatgatagtcacagtgttggtgacaaatatctttcagtgtattcaagaaaaacatcaacggcaggaaattctaagaaactgtagtgaaaagtacatcatgcaaaatgacaactacttaaaagagcagattttgacaaataagactttaaaatatgacgttctcaaaaatagctttcagcagaaaaaggaactggattcacgccttatacaaaagaacagatgtcatagagaaaatgagatcgtttttaaagttttgcaaaatacaggcaaattctctgaagaccacgggtcctgttgtggagtaaactgttattattttaccatgcagaagaaagactggaagggatgtaaacagacttgtcaacattgtagatcatcccttttgaagatagatgacaaagatgaactcgtattttacattcacttttattctcttggactctgtttctcaatgttggacctaagatattgaagacaggctggagcccagagccttcattcaatctcagatttatgaaaataattactggattggattatcatatgatgaaagggaaagtaagtggaaatggattgataatggcacatctcctggaattaattctacaataatgcgtttttcttctgggagaggagaatgtgcatttttgacctcaacaagaatggcaactattgattgcattcaaacgtacaattgtatctgtgggaagagaatagactctattttctctgattcggtgtgcgccaagaagaaaaggtgaaaatggaatgttttctttttttgtttcccataataatttctgattataaatcattgcttttaactgtgggacttagttaattcttcaaaagataaagatgaacaggaagaaaaagaaaattattttggactatgactttaaagatcagatgccatctttcttcctggagaagaggagattttctcttttgagagtggttgttccttcctttaatgtccctgaggaattattcattcttttccagcatcttctggttttgaaagcagttgtgaactagaatgtagttatttttttcttcccatctagaagttacctcatcttttaaaacatttgttttgctacaaaatataacttcaaacttactgaaagttgcaagcatagtacaaggaacttctatataacctttactcatacttactagttgtttatattttgctctgctttatatttctctctttctatcttccacttaataataaattgaggacttcatgtccctttgtctaaatattttccaagatcaagggctttgttttatataatcacagtgcaattatcaaactcaggaaatttagcattagtacagtactatgatctaatctgtaatccatgttcaaattttgtcaattgtcccaataatgccatttatgtgtatttcttaaaaatccatgttcaggataattcaatgcatttgattgtaatgtctctttagtcttctttaatctgaaacagttctttaggctttttcttgaccttgacattttaaaaattaactttattgagttatacttttcatgcaataaa

SEQ ID NO: 123 - DNA, 3557 bp, Homo sapiens
caggacgtgaaacgggggcggtttgggaagtttagagaccattctccgccgaccaaaacccgtcaaaggattatcagacacgcgggtcggacggtccacatcagccggcagcccgggcgggtcccggggtgcgagcagcgcacttccgtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctccccatt

SEQ ID NO: 124 - DNA, 3038 bp, Homo sapiens
aggtcatagagcggctcccagcgttccctgcggcgtaggaggcggtccagactacaaaagcggctgccggaaagcggccggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgcttaagatggtctggttttttttttgtttttgtttggttttttttttccatgaaaacaaatgactgttcctttttatttaatttgggaggcagggggaatcagaaggcccttctttataatgagctattcatattgcaggagtcagaatgaattgatacaggtgaatttttagttacaggctaaattgcataaaagctttgtcagcttccagcatcaggggagtcatttaatagcctttttccttatttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataa

SEQ ID NO: 125 - DNA, 3804 bp, Homo sapiens
cgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcactttgtctcttctaagtcggcctcagcaatagcccaggattaaatatgctctgaaattgggtttagtgtcttcaagatcaaatccagccgggaggaacatgttcataactggacttttccatcctagattttggcaaataagcccaaagttgaaaccatgtgagtggaaaaagcattacatggtacgtataacccccttcaagagttatttcgtcttttaatgtttttttcttgaggtatcttggaaaggacagcagcttggaaaagaa

SEQ ID NO: 126 - DNA, 4169 bp, Homo sapiens
cgcgcgggcccggaccgaaacgtcccccgcgtcggggcgggtctaggggtcccggggtggccttggcggggggtggtccgggtcccgccgcgcgttgggccgcgtcttgccgcctccggccccctgcgcttgaaaacacggagcagacgtgaagttagagcccttggaagcgcccggggctcgcgcacgtgctttgggaaacgggctccctccgagcacccctgggcgccccgacggcctcatttcctgaacggcagctgcgttcttgagcaagtgtcttaacgctccaagtgtcttacgctcatgacgtttcctcatcgacagagcggggagaatggaagtgtgtctccccactgagttttgggcgactttgcattgagatcgccgagagctagggccatgagtaccttgtttttgactggaaggagctgtggggtggaccgtttccctgaaagctagaagaatgtttgaagcctgttcccaaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcactttgtctcttctaagtcggcctcagcaatagcccaggattaaatatgctctgaaattgggtttagtgtcttcaagatcaaatccagccgggaggaacatgttcataactggacttttccatcctagattttggcaaataagcccaaagttgaaaccatgtgagtggaaaaagcattacatggtacgtataacccccttcaagagttatttcgtcttttaatgtttttttcttgaggtatcttggaaaggacagcagcttggaaaagaa

SEQ ID NO: 127 - DNA, 3685 bp, Homo sapiens
ggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcactttgtctcttctaagtcggcctcagcaatagcccaggattaaatatgctctgaaattgggtttagtgtcttcaagatcaaatccagccgggaggaacatgttcataactggacttttccatcctagattttggcaaataagcccaaagttgaaaccatgtgagtggaaaaagcattacatggtacgtataacccccttcaagagttatttcgtcttttaatgtttttttcttgaggtatcttggaaaggacagcagcttggaaaagaa

SEQ ID NO: 128 - DNA, 4297 bp, Homo sapiens
gatctcacccagggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaac

SEQ ID NO: 129 - DNA, 4311 bp, Homo sapiens
ccctccgcccgccctcggaagaccgagacagcggagaggttgcgggtgactgcgctgagcccaggagccgaggagtcgggagcgcagcgcagcccgagcccgagcccgagcggccccgcgtcccgagcgcatcggagcggccgagccgcccggtgcagcgcctgtcccgggcagcgcagccccggccgcaggatctcacccagggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaac

SEQ ID NO: 130 - DNA, 4488 bp, Homo sapiens
ccctccgcccgccctcggaagaccgagacagcggagaggttgcgggtgactgcgctgagcccaggagccgaggagtcgggagcgcagcgcagcccgagcccgagcccgagcggccccgcgtcccgagcgcatcggagcggccgagccgcccggtgcagcgcctgtcccgggcagcgcagccccggccgcaggatctcacccagggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaac

SEQ ID NO: 131 - DNA, 4427 bp, Homo sapiens
ccctccgcccgccctcggaagaccgagacagcggagaggttgcgggtgactgcgctgagcccaggagccgaggagtcgggagcgcagcgcagcccgagcccgagcccgagcggccccgcgtcccgagcgcatcggagcggccgagccgcccggtgcagcgcctgtcccgggcagcgcagccccggccgcaggatctcacccagggtggcagaaggaggccttctggagctgacccacccccgacgaccatcagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaac

SEQ ID NO: 132 - DNA, 1845 bp, Homo sapiens
tggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcctaatttggttgtcttatgttcacttagatttatttctagcccctttgcacttataaagtggacatttgtggtgcttgctttcattcagtgtttatattttttatgtctttcattgtatcaggaatatgttcagctacaagaaacaaaaatctactatactggattaagcaaattggggtttgtttttcttacatacaagaactctagcgggtagactgtccaaagctagtattactgtttctatagttagggacccaggcactt

SEQ ID NO: 133 - DNA, 6179 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 134 - DNA, 5840 bp, Homo sapiens
atggcgacctccggcgccgccacccccgccctccgggaccccagcgcttcctccgcgcagcccggactgggcgtgctcttccggcgcacagcgcgtgtcgtgcgcacgcgcgctgctctcaggtccgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaaggtgagggttccattttagatagaattcctcatttggaagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 135 - DNA, 6107 bp, Homo sapiens
cgtgcgcacgcgcgctgctctcaggtccgcaggttccacccccccccccgccccccccaattacagtgctttggggttcgacatcaaaacagagatcaaatacaaaagtttgggcagatgggcaagagggcagagggacaggggacgcggccaatgtagctcctctacctctacggtgccaggcctacaaagaaggccggccgccgtaagtgaccagaagcgggcccggcctcgccccctccgcctggtgacgtcactcccgcgccgcactcccagtgctgcggctgcctagttgacgcacccattgagtcgctggcttctttgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 136 - DNA, 5957 bp, Homo sapiens
atggcgacctccggcgccgccacccccgccctccgggaccccagcgcttcctccgcgcagcccggactgggcgtgctcttccggcgcacagcgcgtgtcgtgcgcacgcgcgctgctctcaggtccgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaaagaagaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagacaacaagcaattctatttattttatgttgtgtatacatcttgatcattagcaagacattaagctttaaccattatggcaccattttgtgagaatgattgttctttcacttgggctgtttgagagcataattatggtaatcatgagattaatgtttcatgatttctacctccaaagtgtgaagacaagtaaaacaatgtttctaaattgtcttattttgttggcggagaagattacaatggctattagtgctacatttggtcaaatgtaatcacttaaatagcttcttgtcaccttaaactaaagcagaataaaaagtatcctttgaaattataagccctcctttgctgacagctattattttgtaacatcttaccaggtcatgtgctttcagttataactgggctgagcctcctataattacaatgtctatagggactgttttactgcctgtgtattttctgctagagagttagcaatgttagagctagaacagattagaatttctaaacagtatcatgcacagttggtgtgagtgatcagtgtgcattgtatggcatgcatggttgtgaattattctctgttctccaaatactgtttctttaactcagatatttttgttagtgtctaggccacttcatttatttttcgtcatggtactttactgacttctctttattcaattctccacgccctcaccaaaaaaaactgtctcaaaatgagaatattttattttcatggtgagtctagaaaacgcccacttcattctgattaaaaattcttccatgttttaaatatcagaaccagacctttcttactgtgtatcttagcccatttgtgtctctataacaacaaccagctttcaaaggaactaatagagtgaaaactcactcattaccacgaggatggcacaagcgattcacgtaggatctgcccctgtgaccaaaacacctcccattgggccccacttccaacactggtgatcacatttcaacatgaggtttagggaaacaaatgcctaaactacagcactgtacataaactaacaggaaatgctgcttttgatcctcaaagaagtgatatagccaaaattgtaatttaagaagcctttgccagtatagcaagatgttaactatagaatcaatctaggagtattcactgtaaaattcaacttttctgtatgtttgaacattttcacaatctcataggagtttttaaaaagaagagaaagaagatatactttgctttggagaaatctactttttgacttacatgggtttgctgtaattaagtgcccaatattgaaaggctgcaagtactttgtaatcactctttggcatgggtaaataagcatggtaacttatattgaaatatagtgctcttgctttggataactgtaaagggacccatgctgatagactggaaatagaagtaaatgtgtttattgataa

SEQ ID NO: 137 - DNA, 4256 bp, Homo sapiens
atggcgacctccggcgccgccacccccgccctccgggaccccagcgcttcctccgcgcagcccggactgggcgtgctcttccggcgcacagcgcgtgtcgtgcgcacgcgcgctgctctcaggtccgcagcgcttcagcgttttcccctggagggcgcctccatccttggaggcctagtgccgtcggagagagagcgggagccgcggacagagacgcgtgcgcaattcggagccgactctgggtgcggactgtgggagctgactctgggtagccggctgcgcgtggctggggaggcgaggccggacgcacctctgtttgggggtcctcagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacagctggagtgtgttgggagtgtagccagtggtatctctgttatgagttggagtcctgaccaagagctggtgcttcttgccacaggtcaacagaccctgattatgatgacaaaagattttgagccaatcctggagcagcagatccatcaggatgattttggtgaaagcaagtttatcactgttggatggggtaggaaggagacacagttccatggatcagaaggcagacaagcagcttttcagatgcaaatgcatgagtctgctttgccctgggatgaccatagaccacaagttacctggcggggggatggacagttttttgctgtgagtgttgtttgcccagaaacaggggctcggaaggtcagagtgtggaaccgagagtttgctttgcagtcaaccagtgagcctgtggcaggactgggaccagccctggcttggaaaccctcaggcagtttgattgcatctacacaagataaacccaaccagcaggatattgtgttttttgagaaaaatggactccttcatggacactttacacttcccttccttaaagatgaggttaaggtaaatgacttgctctggaatgcagattcctctgtgcttgcagtctggctggaagaccttcagagagaagaaagctccattccgaaaacctgtgttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaaacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtgattgtccaagtgctgaccctacagtgaaactgggagctgtgggtggaagtggatttaaagtttgccttagaactcctcatttggaaaagagatacaaaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcagttcatctgcagcggtggatggggtcataatcagtctatgttgcaattccaagaccaagtcagtagtattacagctggctgatggccagatatttaagtacctttgggagtcaccttctctggctattaaaccatggaagaactctggtggatttcctgttcggtttccttatccatgcacccagaccgaattggccatgattggagaagaggaatgtgtccttggtctgactgacaggtgtcgctttttcatcaatgacattgaggttgcgtcaaatatcacgtcatttgcagtatatgatgagtttttattgttgacaacccattcccatacctgccagtgtttttgcctgagggatgcttcatttaaaacattacaggccggcctgagcagcaatcatgtgtcccatggggaagttctgcggaaagtggagaggggttcacggattgtcactgttgtgccccaggacacaaagcttgtattacagatgccaaggggaaacttagaagttgttcatcatcgagccctggttttagctcagattcggaagtggttggacaaacttatgtttaaagaggcatttgaatgcatgagaaagctgagaatcaatctcaatctgatttatgatcataaccctaaggtgtttcttggaaatgtggaaaccttcattaaacagatagattctgtgaatcatattaacttgttttttacagaattgaagtaaaagatgtcacgaagaccatgtaccctgcaccagttaccagcagtgtctacctgtccagggatcctgacgggaataaaatagaccttgtctgcgatgctatgagagcagtcatggagagcataaatcctcataaatactgcctatccatacttacatctcatgtaaagaagacaaccccagaactggaaattgtactgcaaaaagtacacgagcttcaaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggatcccaaagaatatcttccatttcttaatacacttaagaaaatggaaactaattatcagcggtttactatagacaaatacttgaaacgatatgaaaaagccattggccacctcagcaaatgtggacctgagtacttcccagaatgcttaaacttgataaaagataaaaacttgtataacgaagctctgaagttatattcaccaagctcacaacagtaccaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggaaagctggttgagcagaggaagcacattgatgcggccatggttttggaagagtgtgcccaggattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccgacatggggagagggagtcttgctgtgttgcccaagctggtct

SEQ ID NO: 138 - DNA, 2050 bp, Homo sapiens
taggcctggcaccgtagaggtagaggagctacattggccgcgtcccctgtccctctgccctcttgcccatctgcccaaacttttgtatttgatctctgttttgatgtcgaaccccaaagcactgtaattggggggggcgggggggggggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaagaaat

SEQ ID NO: 139 - DNA, 2125 bp, Homo sapiens
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcgggggggggggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaagaaat

SEQ ID NO: 140 - DNA, 7183 bp, Homo sapiens
gggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagaaactgggtctcactatgttgcccaggttgatattgaactcctggactcaagcaaccctccctctttggcctctgaaagtactgggattacaagcataagccaccgggcatggccccaattctgagcattaatttatttattgggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 141 - DNA, 7183 bp, Homo sapiens
tgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 142 - DNA, 7372 bp, Homo sapiens
cccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccccgaccgtagcaccagagtcgcgggtcctgcagtgccccagaagccgcacgtataactccctcggcgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 143 - DNA, 7450 bp, Homo sapiens
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 144 - DNA, 7170 bp, Homo sapiens
ctgtctacggcagctattccagaggcaacaactgcttccctctgttctcatctccccattggtggctggcgacccgaatttgggaatggggagattgcccacctgttatctttgagcagactaatctcttgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 145 - DNA, 7192 bp, Homo sapiens
tgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaaggttgttctttctgcttctcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 146 - DNA, 7110 bp, Homo sapiens
ctgtctacggcagctattccagaggcaacaactgcttccctctgttctcatctccccattggtggctggcgacccgaatttgggaatggggagattgcccacctgttatctttgagcagactaatctcttaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 147 - DNA, 7381 bp, Homo sapiens
cccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccccgaccgtagcaccagagtcgcgggtcctgcagtgccccagaagccgcacgtataactccctcggcgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactttgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaaggttgttctttctgcttctcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgta

SEQ ID NO: 148 - DNA, 2256 bp, Homo sapiens
gcgcccgccccgcccggcaagatgctgcccgtgtaccaggaggtgaagcccaacccgctgcaggacgcgaacctctgctcacgcgtgttcttctgatggagtctcgctgtgtcacccaggctggagtgcagtggcgcagtctcagctcactgcagcctccacctcctgtgttcaagcagtcctcctgcctcagccaccagactagcaggtctcccccgcctctttcttggaaggacacttgccattggatttaggacccacttggataatccaggatgatgtcttcactccaacatcctcagtttaattccatgtgcaaatacccttttcccaaataacattcaattctttaccaggaaaggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagt

SEQ ID NO: 149 - DNA, 5716 bp, Homo sapiens
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaaccgatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctc

SEQ ID NO: 150 - DNA, 2143 bp, Homo sapiens
gcgcccgccccgcccggcaagatgctgcccgtgtaccaggaggtgaagcccaacccgctgcaggacgcgaacctctgctcacgcgtgttcttctggtctcccccgcctctttcttggaaggacacttgccattggatttaggacccacttggataatccaggatgatgtcttcactccaacatcctcagtttaattccatgtgcaaatacccttttcccaaataacattcaattctttaccaggaaaggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagt

SEQ ID NO: 151 - DNA, 3248 bp, Homo sapiens
ggagtttcactttgtaacttttaagtggtcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctggacaaagacccgtatagttttgggaggacaacaatagcaaacctacagactgacaatgacctcctttggctgcacaccatctttgctgtcatttacctcttcctcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggaaactatgaagaactttgagatgggcaagacaattcctgggtgtcttctggacaagatctagggagttacctagcagacctt

SEQ ID NO: 152 - DNA, 4108 bp, Homo sapiens
ggagtttcactttgtaacttttaagtggtcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctggacaaagacccgtatagttttgggaggacaacaatagcaaacctacagactgacaatgacctcctttggctgcacaccatctttgctgtcatttacctcttcctcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatc

SEQ ID NO: 153 - DNA, 1313 bp, Homo sapiens
tgcactccagcctgggtgacagaacaagacaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagcgtctgaaatgagcctgcgaccttccagcaggatcttcccttgtttttcccgaaatggcctggactttactattgtcattacactgctcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggaaacaccactttcactgggctccgccgcagcgcccggacccagcgcctcgcgtcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccaggtgagcaatcttggagaagaataacc

SEQ ID NO: 154 - DNA, 1538 bp, Homo sapiens
atgcggactcctcgagcggttgtttctctcgttgctcctgggcactggcctcagatggtgccttgcggggctgcttcccaggagcgcgcttctgttccaccacctctccggaaggaaacaccactttcactgggctccgccgcagcgcccggacccagcgcctcgcgtcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagtt

SEQ ID NO: 155 - DNA, 1928 bp, Homo sapiens
tgcactccagcctgggtgacagaacaagacaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagcgtctgaaatgagcctgcgaccttccagcaggatcttcccttgtttttcccgaaatggcctggactttactattgtcattacactgctcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggaaacaccactttcactgggctccgccgcagcgcccggacccagcgcctcgcgtcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagtt

SEQ ID NO: 156 - DNA, 1817 bp, Homo sapiens
atgaggctgacacctttcagcttatcgactggcaactcctttaggtattctagacggctaaagaagaacatttttggcacagctccagccttgagagcgtctgaaatgagcctgcgaccttccagcaggatcttcccttgtttttcccgaaatggcctggactttactattgtcattacactgctaaccacatcacctcagcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggaaacaccactttcactgggctccgccgcagcgcccggacccagcgcctcgcgtcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagtt

SEQ ID NO: 157 - DNA, 1229 bp, Homo sapiens
atggctgctcgcagagctctgcacttcgtattcaaagtgggaaaccgcttccagacggcgcgtttctatcgggacgtcctggggatgaaggtggagtcttgctctgtcgccaggctggagtgcagtggcgcgatctcggctcactgctctgactacacccggataacagaagacagtttctcaaagccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtggtggagtgcagtggggcaccatcgtggctttctgcagccttgacctctggggctcaagagatcctcccacctcagcctcccgaatggctgggcccacagccacgtgccaccacacccagccaacgttttgatcttttgtagcgaccgtctcactgcgttgttcaggctgcaagctgttgtttcaaacagatgaagttggaaagttcttcagcttctccagagtt

SEQ ID NO: 158 - DNA, 2646 bp, Homo sapiens
tgcactccagcctgggtgacagaacaagacaaaaaaaaaaaaagatacactgggtaatcactaacccattattccttgtggcgttacgaggtcggaccaatccttgatatcctcaaatttcaccttaatgaggctgacacctttcagcttatcgactggcaactcctttaggtattctagacggctaaagaagaacatttttggcacagctccagccttgagagcgtctgaaatgagcctgcgaccttccagcaggatcttcccttgtttttcccgaaatggcctggactttactattgtcattacactgctcctcctgtccccgggataagctttatcgtagcgaagcccagactcttcccaggtgctgggagcgcgggatgcggactcctcgagcggttgtttctctcgttgctcctgggcactggcctcagatggtgccttgcggggctgcttcccaggagcgcgcttctgttccaccacctctccggaaggaaacaccactttcactgggctccgccgcagcgcccggacccagcgcctcgcgtcaaggtcccaagcctggaccacctgcagcaacggtcgcacgacaaacctcgcgggtctcaccagcgccgccatgttccctgagacccgggctgcgtcacgaaagcgcgccgtcggcggctagtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctgaaatcaagctgtgataccagtctctaagtctcatcatgtaaagtggtggccaggttcagatttttaaaaataaacttaggagattggaagggattgactcagaggatcctggttcccaaagaacacatagagaattacttgtaaatcgtaacctc

SEQ ID NO: 159 - DNA, 1733 bp, Homo sapiens
gtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagcagattacgttagtaa

SEQ ID NO: 160 - DNA, 1429 bp, Homo sapiens
ggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtggggtgttttttaaaataggaaatgtcagtatcaatctaatattatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgat

SEQ ID NO: 161 - DNA, 1958 bp, Homo sapiens
tggggttctgagcgagtcgtgcgttttaggtttagtgtcttttccttgtccctgctcggggagcgtgaggcagatcggccggctttgctccaggcctcaggagtgtaagtttaagggcgcgaacctgggtgggacggggcagtttttccagcgggccatacgggaaaatttttggttcgaggaagacaaccaccctttttaaggagaaaactgcatcttgccctgccttattcctacgcggtgcccaggtggggtgtgtgtggaccagtcaatgaccgcccaagctctccgagtagaaaacccaaacatggttttgtggggtgtgtgcctttgaccccggacttaagcaacaagcgtggtcttgggcgtagctacgaggtggttggtgggctccagggcctgcgtgcccctcgacgtgagcgatgattggcggtgcaggataacagatcgccttcttggccactcagtggcaggggacttgctacttccgggtcggcggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtggggtgttttttaaaataggaaatgtcagtatcaatctaatattatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgat

SEQ ID NO: 162 - DNA, 2639 bp, Homo sapiens
atcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacgtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggcattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagaccccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtatttttgattaagatcagctcatcatcacaaattctctcctgtaccacttcttctgcctgtcccaacattgcagcttcaaaagtttcttcaccttccaaattggccagggttgacagaatagttgctccagaagctttggcaatgcgtttaaggtccctttttaaaactcttctaactgccatagcaccagcctccacaaaatacttcagacacatatcatcaattccaccagtggttagaataacattggcaccagttgccaggatcttctgaattctctccttggtgatatct

SEQ ID NO: 163 - DNA, 2020 bp, Homo sapiens
atcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacgtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaa

SEQ ID NO: 164 - DNA, 1599 bp, Homo sapiens
gtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaa

SEQ ID NO: 165 - DNA, 1894 bp, Homo sapiens
gacgtgtatcgctgccgtcaagatggaggggcctttgtccgtgttcggtgaccgcagcactggggaaacgatccgctcccaaaacggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaattgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacggtcctattcccataatggaaggctccacacccacttgggaccaggaaactatccgtgctaaaggtgtaagcccacgtttatcagcttctgacttcttcataagaacgacagctgcagcaccatcatttattcctgaagcattggctggggtgactgttcccgttccatcagtaagaaagtaaggctttagcttggacatggcttctatgttgctcccatggcgaggaaactcatctgttttaacttcaataagaccttttctagttgacaccaaaactggtacaatctctttgtcaaaatggccagctttctgtgcattctctgtcctgttctgggacagaactgcaaccttgtcctgatcttctctactcacttgccattttttggctacattttcagctgtaatacccatatgacagttgtgaaatgcatctgtaagaccatcacagagtatactgtcagtcagtggcatctcacctatctttactcctgttctcaagtaagccaagt

SEQ ID NO: 166 - DNA, 2439 bp, Homo sapiens
cctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 167 - DNA, 2789 bp, Homo sapiens
cctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacggtcctattcccataatggaaggctccacacccacttgggaccaggaaactatccgtgctaaaggtgtaagcccacgtttatcagcttctgacttcttcataagaacgacagctgcagcaccatcatttattcctgaagcattggctggggtgactgttcccgttccatcagtaagaaagtaaggctttagcttggacatggcttctatgttgctcccatggcgaggaaactcatctgttttaacttcaataagaccttttctagttgacaccaaaactggtacaatctctttgtcaaaatggccagctttctgtgcattctctgtcctgttctgggacagaactgcaaccttgtcctgatcttctctactcacttgccattttttggctacattttcagctgtaatacccatatgacagttgtgaaatgcatctgtaagaccatcacagagtatactgtcagtcagtggcatctcacctatctttactcctgttctcaagtaagccaagt

SEQ ID NO: 168 - DNA, 3919 bp, Homo sapiens
actccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggcctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccagtgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtgcttattttccactaaacacagacacatgaaatgaaagtttagctagcccactatttgttgtaaattgaaaacgaagtgtgataaaataaatatgtagaaatc

SEQ ID NO: 169 - DNA, 4921 bp, Homo sapiens
caactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatgaacaggatccgaaagtttttccgaggaagtgggcgagtcttggcatttatctttgtagcttctgtcatctggctcctctttgacatggcagctctccgcctctcattcagtgagatcaacactcgggtcatcaaggaagacattgtgaggagggagcggataggattcagagttcagccagaccaaggaaaaattttttacagcagcataaaagagatgaaacctcccctaaggggacatgggaaaggggcatggggcaaagagaatgttagaaaaactgaggagagtgtgctcaaggttgaggtggacttggaccaaacccagagggaaagaaaaatgcagaatgccctgggaaggggcaaggttgtgccgttgtggcatcctgcacatctgcagaccctccctgtgactcctaacaagcagaagacagacgggagaggcaccaaacctgaagcctcctctcaccaggggacaccaaagcaaacgacagctcagggggctccaaagacctcattcatagcagcaaaaggaactcaggtagtcaaaatatcagtacacatgggacgtgtcagtttaaaacaggagccccggaagagtcatagtcccagcagtgacacatcaaaactagcagctgaaagggacttgaatgtgaccatcagtcttagtactgatagaccaaagcagcgatcacaggcagtagcaaacgagagggcacaccctgccagcacagcagtgccgaagtctggggaagccatggccttaaacaaaactaagactcagagcaaagaagtcaatgcaaataaacacaaagccaatacgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccacggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgaca

SEQ ID NO: 170 - DNA, 3796 bp, Homo sapiens
ctctgccagggaactggcaagcaacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaagtttgtgtctttatt

SEQ ID NO: 171 - DNA, 12678 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgacggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcgaatctgtgcagagagtaacgcggagtgtcaagagatgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgtatttcctggttactgtatcccagtgaccagccacaggagatgtccaataaagtatgtgatgaaatggtcttaaaa

SEQ ID NO: 172 - DNA, 11602 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcgaatctgtgcagagagtaacgcggagtgtcaagagatgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgtatttcctggttactgtatcccagtgaccagccacaggagatgtccaataaagtatgtgatgaaatggtcttaaaa

SEQ ID NO: 173 - DNA, 11598 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagagtgacggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcagtgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcgaatctgtgcagagagtaacgcggagtgtcaagagatgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgtatttcctggttactgtatcccagtgaccagccacaggagatgtccaataaagtatgtgatgaaatggtcttaaaa

SEQ ID NO: 174 - DNA, 4693 bp, Homo sapiens
cgcgaggcccccgttgccgagcgcgggcgcggggggcggagctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaattcaaaatcaggtacattacaggaatatcagaagagaatgaaaaaactagatcagcagtacaaagagaggatacggaatgcagaactcttcctccagctggaagtaataaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgagga

SEQ ID NO: 175 - DNA, 2386 bp, Homo sapiens
cgcgaggcccccgttgccgagcgcgggcgcggggggcggagctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagatatcctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgatagagcaactgttagcgtctctatgagcaatcagtagaacttacacatcctaggaaatctttctttgtaagta

SEQ ID NO: 176 - DNA, 2216 bp, Homo sapiens
cgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccgctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatga

SEQ ID NO: 177 - DNA, 4773 bp, Homo sapiens
cgcgaggcccccgttgccgagcgcgggcgcggggggcggagctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagatatccactaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgagga

SEQ ID NO: 178 - DNA, 2284 bp, Homo sapiens
gcaccgagggcgcatgcgcgagggcagcgaccgcgactcagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcag

SEQ ID NO: 179 - DNA, 4054 bp, Homo sapiens
gcaccgagggcgcatgcgcgagggcagcgaccgcgactcagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttccactgctgtctctggagcaggagctggcaaactatggcctgctgtctgtttttgtacagttttactgaaacacagccgtgcccatttgtttactcattgtctatggttgctttcatgccctcacagcaaaggcgagtagttgtgatggatcaaatggcccacaaagcctgaaatatttactctttgaccctttacagaaaaaaaccttgttgacccctgctttagagaatgagaagccatgcagggatcagtgatgccagaggaagggaaggaactgcttccagctattgtgacaataataataataataatattgggtctttgactagaacgtgtaacatttccaggtgttctcacttgtgcttcccatgtttatcttacggaaggtcattccatcaagcttatggtcactgtcccttcatggcagttggtcctttcgttctccctttagctctaagagttggggagtacccacaggtgagctgtgatctcagctcagagagagagcatgaggtcttttttaactgtcaggaaacagagctgtgcccaattccactcaacttttggcac

SEQ ID NO: 180 - DNA, 10471 bp, Homo sapiens
atggagacaactccggggctggggctccgaagtcccggcgcaccgctggctcagaaccccgcggagctgctgtgcgaggccggagccgcggtggcggctgcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 181 - DNA, 10372 bp, Homo sapiens
gcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 182 - DNA, 10475 bp, Homo sapiens
atggagacaactccggggctggggctccgaagtcccggcgcaccgctggctcagaaccccgcggagctgctgtgcgaggccggagccgcggtggcggctgcacgctgggacctgcagaagcactctttgctaattgtgatcggcgatatcggtacagagagtcagctgagggccgtgcgggcccaccttgaacaagggattctctcctggaacattgacctgtcatcctttgacttgaaccaacagttgagactcttcattacccggcacctagctcacttctcctcagaggtcaaaggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 183 - DNA, 10177 bp, Homo sapiens
gccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 184 - DNA, 10240 bp, Homo sapiens
ttccctgaagctgccggctgaggccggagctgccgcctccatgagaggcttcctcctacaccccagggccagaggaccctttgccaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaatggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggaaggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgca

SEQ ID NO: 185 - DNA, 6270 bp, Homo sapiens
cgttgtttggcgtgtttttttttttttttgttttttgtcactgcctgcctgggtcctgcccgaggtctccatcctcggtttccctgtccttgccccgggccctgggagtgctctggaaggctgcgcagtattggaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactggg

SEQ ID NO: 186 - DNA, 1527 bp, Homo sapiens
atggaagctcagaggagggagcccctaaattactctgggaaattcaaagaagatttcatcagtgcatttaactatgatggtactcctgctgtgagacaagaatggcagaatgactcccatgccctgacagttggaagagatcaagctcccaaggcgccgtctgctttcatgggtttggcctgccagggaagagctcagcaaatccagctgaaagaggtgatgaagtcagacctactggttacttggctgcagaaagctctgggtgtgcggcagtaccatgtggcatcagtcctgtgccaacgggccaaggtggcgatgagaccctttgagcctaagtacatccactatgacctgctagagaagaacattaacattcctggggggcatctgcattggagttgggggtgccgagctgtggatgtcatgactgggatcccctgggagctgaagtgccccaaggtgattggcgtgaagctgatgggctccctctctggttggacctcacccaaagatgtgatcctgaaggtggcaggcatcctcaccatgaaaggtggcacaggtgcaatcgtggaataccacgggcctgttgtagactccatctcctgcactggcatggtgacagtctgcaacatgggcttagaaattgggacaaccacttccgtgttccattacaacctcaggatgaagaagtacatgagcaagacctgccaggcagacattgccaatctagctgatgaattcaaagatcacttggtgcctgaccctgggtgccattatgaccaactaattgaagttaaccccagtgaactgaagctgcacatcaatgggcccttcacccctgacctggctcaccctgtggcagaagtgggcaagatccgtgcctccattgagcaggatggctatgcacagaccttgagggatgtgggtggcatcgtcctggccaatgcttgtggcccctgcattggtcagttgcacagaaaggacatcaacaagcaggagaagaacataattgtcacctcctacaacaggaacttcatgggccacaatgacacgaaccccgagacccatgccttcatcacatccccagagactgtcacagccctggccattgtgggaaccctcaagttcaacccagagaccaactacctgacaggcaaggatggcaagaagttcaagctggaggctccggatgcagatgagcttccccaagcagagtttggcccagggcaggacacctaccagcacccccgcatgggtggtgccatcaacattgaaaatggcaaggccaactctgtgcacgatgctgtcacccacgagtttggccccttccctgacactgcccgctacaagaaatatggcatcaggggccgggccatcatcaccaagagctttgccaggattcacgagaccaacctgaggaggcagggcctgctgcccctgaccttcgctgacccagctgacaacaagattcaccttgtggacaagctgaccattcagagcctgaaggacttgacgctggcaagcccc

SEQ ID NO: 187 - DNA, 2193 bp, Homo sapiens
atggtgccctacagcctactggttacttggctgcagaaagctctgggtgtgcggcagtaccatgtggcatcagtcctgtgccaacgggccaaggtggcgatgagaccctttgagcctaagtacatccactatgacctgctagagaagaacattaacattgtttgcaaatgattgaaccggcctctgaccctctcagagaagatcgtgtacagacacccggatgaccccaccagccaggaaattgagcggggcgggacgtacctgcagcagtggccggacagcgtgaccatgcaggatggacggcccagatggccatgctgcagttcatcagcagcaggctcccaaggtgaccatgccatccaccatccactgtgaccatctgattgaggcccagctcgggagtgagaaagacctgcaccaggccaaggacatcaaccacgaagtttataatttcctggcaactggaagtgtcaaatatggcttgagcttctggaagcctggatctggaatcattcaccagattattctggaaaactatgaatatcctggggttcttctgattggcactgactcccacacccccaatggtggcagcctggggggcatctgcattggagttgggggtgccgagctgtggatgtcatgactgggatcccctgggagctgaagtgccccaaggtgattggcgtgaagctgatgggctccctctctggttggacctcacccaaagatgtgatcctgaaggtggcaggcatcctcaccatgaaaggtggcacaggtgcaatcgtggaataccacgggcctgttgtagactccatctcctgcactggcatggtgacagtctgcaacatgggcttagaaattgggacaaccacttccgtgttccattacaacctcaggatgaagaagtacatgagcaagacctgccaggcagacattgccaatctagctgatgaattcaaagatcacttggtgcctgaccctgggtgccattatgaccaactaattgaagttaaccccagtgaactgaagctgcacatcaatgggcccttcacccctgacctggctcaccctgtggcagaagtgggcaaggtggcagagaaggaagaatggcctctggacatctgagtgggtctgtggggcagctgcaccaattcaagctatgaagatatggggtgctcagcaggtgtggccaagcaggcactggcccatggcctcaagtgcaagtcccagttcactattactccatgctccgagcagatccgtgcctccattgagcaggatggctatgcacagaccttgagggatgtgggtggcatcgtcctggccaatgcttgtggcccctgcattggtcagttgcacagaaaggacatcaacaagcaggagaagaacataattgtcacctcctacaacaggaacttcatgggccacaatgacacgaaccccgagacccatgccttcatcacatccccagagactgtcacagccctggccattgtgggaaccctcaagttcaacccagagaccaactacctgacaggcaaggatggcaagaagttcaagctggaggctccggatgcagatgagcttccccaagcagagtttggcccagggcaggacacctaccagcacccccgcatggggtaccactgaccacatctcagctgccggcccctgactcaagttccgtgggcacttggacaccatctccaacaacttgctcagtggtgccatcaacattgaaaatggcaaggccaactctgtgcacgatgctgtcacccacgagtttggccccttccctgacactgcccgctacaagaaatatggcatcagttgggtggtgattggggactagaactatggcaagggctcaagctgggagcacgccgcgctggagcctcgccacctcagggggccgggccatcatcaccaagagctttgccaggattcacgagaccaacctgaggaggcagggcctgctgcccctgaccttcgctgacccagctgacaacaagattcaccttgtggacaagctgaccattcagagcctgaaggacttgacgctggcaagcccctgaagtacatcgtcaagcaccccaggaaatcaacctcctgaaccacaccttcaacgagacggagatcgagtggttcagggccggcagtgccctctacagaacgaaggagcagcagcaa

SEQ ID NO: 188 - DNA, 4871 bp, Homo sapiens
cactctgcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagtgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccctgaa

SEQ ID NO: 189 - DNA, 4889 bp, Homo sapiens
cactctgcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggctctgctgtgctcctcagggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagtgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccctgaa

SEQ ID NO: 190 - DNA, 4820 bp, Homo sapiens
gcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagtgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccctgaa

SEQ ID NO: 191 - DNA, 2017 bp, Homo sapiens
agttggcgcccatggagccagagctgctggttcggaaggtgtctgcattgcaggcctgcgtccggggcttcttggtccgacgccagttccagagcctgcgagctgagtatgaggcgattgtacgagaggtcgagggcgacctgggcacgcttcagtggaccgagggccgcattcccaggccgcgattcctcccagagaaggcaaaatcccatcagacctggaaagcaggagacagggtagcaaatccagagcaggggctgtggaaccacttcccatgtgaagagtctgagggagaggccacctgggaggagatggtgctgaagaagtcaggagagagctcagcaaatcaaggaagcctctgcagagatcacagctcctggcttcagatgaagcagaacaggaaacccagccaagagaagaccagagacacgacaaggatggagaatccagaagccacagatcaaagactgccccacagccaacctcagcttcaagagcttcagtaccaccgcagccacttggccatggaattgctgtggctgcaacaggccatcaatagccgtaaggagtacctacttcttaaacaaacactgagatccccagaggcgggcccgatcagagaggaaccccgcgtgttcctagaacatggggaacaggcctgtgagagggaccagtcacaaccaagcgcaccactggaggaccagtcctacagagacaggaccactggagagctagaacaggaggatgactcctgtcacagggtcaaatcaccccacagatccccaggaagtttggccactacacaaaaaaacattgctggggctaagtgcagagaaccatgctacagcaagtctggaccaccgtcgtctataccatcaaacagccaggccttgggggacaggctcaccaaagggccagacgatggaagacagacctttggagggacctgcctgctgcagatgaaaatcctggaggaccagacccccagaggtttaaaacctaggaaccattgtcccaggaagtccaggacacagctgtctgcactctatgaggactcaaatattaaggagatgtctcccagaaaactagaccacaaagagcctgactgccgaacagtcaggacacaagagttgggcctctcagaggaccacatcatctgggatggtaccttgggggggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctacaaaggcaggctgtacaggagaggaacagtggaggggcaggccatggaaaacagaaccacctggctagaccctaggaagccaggagaggatcaggttccaaaggggaatgctatgaaagggcagtgagacaagacctcatcctacctccctgaccagctctggcttctgctcctgcccctggccattggtgactagtggggccaagagaagctggagcagagagctggcatgagtatagggaaggaggaaggacacattttcaatcctctgcctgtagctcaatccaaatttgtggataaggggccgggtgcagtggctcacacctgtaatcccagcactttgggaggccaaggtgagtggatcacctgaggtcagaagtttgagaccagcctgaccaacatggtgaaatgaaaccccatctcaactaaaaatataaaaattagccaggcgtggtggtgcatgcctgtagtcccagttactcgggaggctgagacaggagaatcgcttgaacccaggagatggagattgcagtaggccaagatgatgccactgcactccagcctgggctacagagcgagacacggtctcaaaaaacaaatgtgtggctaaggagttacctgggggaagtagaatgagaggtctgttgggaataaaggtttttcttagattctg

SEQ ID NO: 192 - DNA, 1873 bp, Homo sapiens
cggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtaggaagttaggagatcatttactttcaatcacaagggaggagaactgttcctggggcccaaggctgccagtttccagctcagagctcctcccaccccaacatactgtttcctgatccaacagcttacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctg

SEQ ID NO: 193 - DNA, 1035 bp, Homo sapiens
cggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggctt

SEQ ID NO: 194 - DNA, 1508 bp, Homo sapiens
cggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggctt

SEQ ID NO: 195 - DNA, 1233 bp, Homo sapiens
tatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaacccccttt

SEQ ID NO: 196 - DNA, 1217 bp, Homo sapiens
ccgcggttcaaaggctcccccgcagtgctttttaaattgacatatgcagtgataacctgctttagcctcaggctcactcacccgcccagaccctggagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaacccccttt

SEQ ID NO: 197 - DNA, 1329 bp, Homo sapiens
ccgcggttcaaaggctcccccgcagtgctttttaaattgacatatgcagtgataacctgctttagcctcaggctcactcacccgcccagaccctggtatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaacccccttt

SEQ ID NO: 198 - DNA, 946 bp, Homo sapiens
tgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctgat

SEQ ID NO: 199 - DNA, 1653 bp, Homo sapiens
ggccaacaacacctgctgtccgtgtccatgcccggttggccaccccgtttctggggggtgagcggggcttggcagggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtc

SEQ ID NO: 200 - DNA, 90 bp, Homo sapiens
accatcttcagtgtaactcagggaaatgacctcactctgttgctcctcgtccttggaaacggagctggttgtatctaccgtgcagggatg

SEQ ID NO: 201 - DNA, 252 bp, Homo sapiens
atgcagaagtcctcttctactcgggctggggatatgcgtgagaaagacacgcgtggatgccgtatgagctctcgttctgaatgcggaaatctgacctcccaccggatactcagttcagggggctcctggaccctccagctgctcctctactcatcgctccctcactcagaaaaccagcagagaagtgaacttcctcaaatgactgacggtaaatatccagcatggagctggattacaaaactgtataaactg

SEQ ID NO: 202 - DNA, 418 bp, Homo sapiens
tttacattagttttgattacattagtttagaatgaaattttaaatacactagtatatgtaattaaaattgtatatacgttttagtcaaccatcagctgacttattcatgttctgtggactctatggtgggtggggtccaagcctccctgaagcagatctctatcctgtcaccctgctggaaatgaaacacttaggggttagaaggggatcaaggaaagtccgagagttggttgtgattatcttcagtcagaaagtgcctacttttccaagcatccagactgcaacctgtctttcctactcaaaatggtttttatggattctattcttatttggcaattgcctggactacagtcaccaacacaagtttatacgcaagaagtgcacacagccctccctcccagctcatccggtaacaatt

SEQ ID NO: 203 - DNA, 432 bp, Homo sapiens
atgaccagttatacttcatcaactctaacaaatgaaggagcagagttggttttccggagtttgcttcagttctttgatatgaggcaagaggtactcgatgaaccacatgctaaaataaaaaaaaatgaaccacatgctaaaatcaaatggcttctgcacctgtgtgcgttcctggactctggggtcacaggatggctgatgagatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctac

SEQ ID NO: 204 - DNA, 13643 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcacacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcagt

SEQ ID NO: 205 - DNA, 13653 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcacacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaactggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcagt

SEQ ID NO: 206 - DNA, 12200 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcacacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatggtaacgggacacacctttcactgtccatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcagt

SEQ ID NO: 207 - DNA, 12728 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcacacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaactggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccaggtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcagt

SEQ ID NO: 208 - DNA, 4058 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtgtccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacct

SEQ ID NO: 209 - DNA, 727 bp, Homo sapiens
cgggcagcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaa

SEQ ID NO: 210 - DNA, 1150 bp, Homo sapiens
tgtggagccatttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagacacacctgggaacccaggatggaaaaggtgaacctgcgatttttaacctaagcatcacagaagcccatgaatcaggcccctacaaatgcaaagcccaagttaccagctgttcaaaatacagtcgtgacttcagcttcacgattgtcgacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcctgacctcagatgatctgcctgcctcggcctcccaaagtgctggaactacaagcctgagccaccgtgcccggccctgaatcgctttagtaaataaagggtctccaagaataaattcatccgaacatgc

SEQ ID NO: 211 - DNA, 1599 bp, Homo sapiens
ggagaattgcttgagcctgggaggtcaaggctgcagtgagttgtgactgccccactacactccagcctgggtgacagagcaataacctgtctcagaaaaaggaggtacattttatggtatgtcaaaacatctgaataaaactagtatttaaaaaaaaaaaaccttgggaaatacaatcagtatatacctctagttggccaaaatgatattcctcaatgactatttttacgattaaataactgacagatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccaggtgggctcctggcacttgcttacgctgttgtgcttagtcctgaccacttgcccttgtggcaaaacttgcttagtctgttgacaataaaccttgtgttaactgaagtttgcactctacagattagaggaccccatttcaagattgaaatttaagatcaaataatacctgaccatagtacagtatatttccctatttccattaaaatgattttaagcctgtgaacattaagaaatgttacatttggactacaaacattaaatataatatttgttttttttcttcctataaacagttttcattgctggcagaagccatatcacaggaacatcaagaacttaaagccagagagaaatctcaggcccaggtaataattaagatagaagccaagtcatgcactgcatggcaatgtttctttcagcaagggacctcgtacattggtggttggagcaataggctgtatcatatagccccggtgtgcagtggactgtactctctaggtttgtgtaagtacactgacattttgcacaacaacaaaatcatttaatgatgcatttcttggaacatatctccatcattaagtgacacatgactaatttacatttttaggaagtagaaaaccaaatgtattatacctgtaaagggaatggagagaagactaataaggcaatccatctatgacccaagacatttttatcctatgattttaactttagttaggtctctgtaagagctgctgttgctagattattgaaaattttggaggagtttgattagctggaagatggagagggaacaatagatgagggcctggataaatgctgtgaacagcgggatgacatgccttcttttttcagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttattg

SEQ ID NO: 212 - DNA, 2874 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttattg

SEQ ID NO: 213 - DNA, 1809 bp, Homo sapiens
gtctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctggccgtggaacagcagtatgctgtgggagagagagaggcactggggcgaggccgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattgggcaaatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggttcttccccatctcttgactaccattaagcagcagccagtaccatttcccctcagccagatgctaccatga

SEQ ID NO: 214 - DNA, 960 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtctaatatatacttacctggcaatatttcctagagctgatcaggttcttcaaaatgccagttaacagtaatgggaaacaaatctttattatcactaatcatatcagctgtgcagggcagcttcaacctgggacctgagctagcattatcatttaccactgaagaaggaggggttcgaaggaagaccatgggttcagtgctgggttcttcctctcactatatgatggcagctctctaagcctgttttctcatctgaaattctttcatggttgttgtgaaagttaagtaagtagatgtgtgtaaacagttgggcacacagcctagctcagagtaaatgcataataaatgttaattgatgtt

SEQ ID NO: 215 - DNA, 2197 bp, Homo sapiens
gcgacatatgccaatgtggccatctcgggtgatttaaaagatttgttaccctctgcgtgcacttatagcccaggtatgtcctgtctcccctggatggctgattggtgatttttaaaagggtttccattgtgctgtgggaacctgaaggcatcagaacgggcttttgcttgtttgctgtgtcatattctgttcatttaaagagtaaaagtgtgtggttggtattgtggcccatgttgagccaaagcaaagagtaagccactgtctgaagcccacctacgttgaatgtaatgaggctgagatgaaaaggatctgctacactgaacacagaacgtggaggtctgggctaaccacacaaaatatgctgtgtgcagtgaacattcacgctgtactcttagccacatcccgcacaaaagacagagagacagctcccaggagatggagcatgtgtggcaaagattttccgcctggttactttgaagaaagcaaaaggaggctgaaactgtgctttgtaagctgcatgggttggtgctggctcctggacgtcagttcagaacactcaggagtgaaggcagaaacctggtgagggactcccaggaggagcttctttctccacctttcagcctctggagttcaaatttcactcaacctgagtgcaccaaaccccaccctcttatttacattgccctggcctttttggcggaatcaaagtccctacatagccaaggagatcttttaccttctacactagtgggaggccaggtgcctgggagggaggtggcacgcccccgccctcctctggcatgccactgtcctgctgtgaaagcctgtgtcaaggaaaactgggctcagaggtgcagactgagagagccgctgggctgttttgaaggaaggtaagcagagagcatttgtgtgtgtgtgtgtgtgcgcgcgcgtgcatatgtgtatgtgtgtctgtgcctgtgtggtgagtgtgtgtgtgcatgtgtgtggcttctgtaatgctacaaagacctgaaactgagctgtgtgcctgctgagatttaccaacttgccaagacttccagaggaaaagagctggtactagccaggaggagagggcgttatggagtggaataatcagcagaacggatgctttaaccgggcaagaaggaatgtcgctcaggacttgtccaggaatgcctttattggtttgcaagctggaggagtcttaacttactgacttctttttggggaagagtcagtgatggtctgacatgctgtttgcaagctctctggccgcctctgtggccagccggcgtgggtggcctcagataaggccaacaggacctcctcttttcctctgggcttgggcccctgtgttttcagttaggagtgcccaaaagggaactgagctgcccagtcaggggcctgagataggcgcctgctgaatgctgagcctgcaccggcgtgctggtgtgagaggtctgcccggggagccgccctggcctgccctgctgtcagtgcggctgtgggggcaccttggcggcgtctgtgacacgcctgccacagccccactcggagcacagtgctcctttatcgccacattccagagcctcacccaggagaccgcgggagcgcttggaatctggcccagctcctgagtcgctcctgctctgcagtgggatgccttcccttcccagagaggcagtgtgtggctgggcaggcgtttctgtgtggaaggttctgctctggttcttgcttttgttaattttttttctgctctatatttctctaagaatttacagtctgcctcatttttagaaagcgtgagcaagcagctcagctttacttcagagggagggattttccagcgccctccggcagtctcagcaaggtgtcctggtgctgccgctgcagcctctttcctgctgggcacctcccctcctggcagctcagagggtgatttgggtttgggggcttgggaaggagttaactctcaaggtgagactgatgcaccaagggagcaatgccttagaatggagttattctgcctaaggagagaaagagttgtccctacagagtagagtttattaccgtcttttattttttgtaaaaacaaaaataaaaaaagaggaaaagggcacatttcatcgcgtcttgaaatatatcaaaatcatagagtatctgatttagtagattaaaagcagtgttctcaaag

SEQ ID NO: 216 - DNA, 2474 bp, Homo sapiens
tttctgctacagacaggccagggacttagacacaaatggcgagggatgaggagcttgatgacgtgtcaagggggattagatatcaagtgtgggggatgaaaagcaggattcttgctggaactgagcttgccacggttggacgtggaaggccaatgttgaggcctagtggagaagagggcttggaggagcctggctaaggtttggtcaaggagagtctgtcacaagatagacccatctgtatccaggctaacgcaatagggtgaccaaatgcagcccgcacgcttctctgtgtttctctccaggtcctttgggcacttagtttataattttttattttctattttttatttttatgggtacatagtataggtgtgtatggagtacatgagatgttttgatacaggcatgcaatgtgtaataatcacatcatggaaaacagggtattatgggcacttagtttagccataaggcttccgtgccaagtggcctgggagccagctggggccagcttctgccacaggcatccttcacccacccttctcacaaacaagcgattcttcaataaacaataaacagaatacacaaaaagcaaaccaaaacatctctagatttattaatagatgggtgaattaaaggagtcttttccaaataatgtgactaacagaagccaagggggatgaatgcccaaagctggggcttgccagaacctgctggtaccgagagctgattgctgaagtgtgaggaattttgtgagccagctgacagcacattggcagcttgggatctgccagggcgggattgtttacaccacaggatttagcaaacgttatgaatcaacccctccatcggccccaagcttccctgacacaccaaacagtagaaattcactgccttttttttttttttttttaactctgcttggtgttagctaactagtcatgaagaatagaggctgaagtgaccaaagagatctttctgcattttgacattcaaatatttggaaagattttccgcattcagcatttggattctagtcccattgccaggctcaagtaagctctgtgataacaacactcagctgttggaaactgctgtccgaagcatctctcagcagatagggaggcctaaaaggacacggcagagtggtgtctggtgggtcctctcctgacatttcttctctctctggtcaaatgctggatgcacacatatagtggctctgagacttcctatctgggtgagctcaggcagttctagggacctctctgagccctagtttcatgtcctgtacaacagtagtcattcctactgcacatggttcttgagaagattggaccagaacatgtagctctggctcctggcccagacctgatcaacactcagcaaatagtggacactgatgctgttaggagaacagagcatccatatgaagggcggttccctgagctggggagaccagtgacaactgtaagtctgggttcagagcatgagtcgggggacggagaaggcccctgggcatctggccctgggtggctgagccctgggaatcctgcttttcccagagatgtgcttgtgcccagtgtgctcatgttttaaatgccagcacctactccaggaaaatgatgggtatttcaatatctgctcacattatgcatatttaaatatgaatttaaatactgtttaattctcctagggatgtgttgtcatttaaaagaggttgtgattagcatgaaggactggggacaggagcaggagatggcagagcagctgtaggcactgatgtaatgcctccagctttatgaggacgggcccaaccaggcttcacccatttggggccctcaagcgggagcgtcagtggcagccctcgccatcgtccgtctgttgaatgtattgccacatggccacattatgccccaggagccatgtgttggaggacagtatccttaggcttctcagaaattccacatgggagcctcaaatggacatgcttttcttgaaaacaaaaatatttgtaaaaatgtaacaatgggagtcgtttaatctcaagtctcccctataagcaaaaatagataaaattatgaaatgtaagatgtaaattattctgtttcttagctgatccttaatcttgatgatattttcaaaacaaatgaataataaagacatgagaaaaggtttcctttaaaaagtcgtggttctcgccaggcgcagtggctcatgcctgtaatcccagcaccttaggaggccaaggcaggcggatcatgaggtcaagagatagagaccatcctggccaacatggtgaaaccctgtctctactaaaaatgcaagaattagctgggcatggtggcgcatgcctgtagttccagctactcgggaggctgaggcaggatttaaatactgtttgaacccaggaggcggaggttgcatgagccgagatcgcaccactgtactgcagcctgacaacagagtgagactctgtc

SEQ ID NO: 217 - DNA, 7799 bp, Homo sapiens
ccggcagccagccaggaggacgggcccgcccgcgcgctactcggagcccagcctcgttgcggccatcgccctgccggaccgcgcctcaggctcccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggcagagccttccacctccttctctgggccccgctcccaagctccccaagcacggaccgactcagaggtttccatccttgaggtctaccagttctttgaagcagagagaagagtttcaaggatcctgttagatcagcatccaggtgttccatttggtcagaagagccaaactcaacatctgtggctttggcaaaagtcaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggctgagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaacgcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggt

SEQ ID NO: 218 - DNA, 4662 bp, Homo sapiens
cagtccttccagcttgagcactgcactcgactcatgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaacgcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggt

SEQ ID NO: 219 - DNA, 2162 bp, Homo sapiens
agccagccaggaggacgggcccgcccgcgcgctactcggagcccagcctcgttgcggccatcgccctgccggaccgcgcctcaggctcccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacaccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggt

SEQ ID NO: 220 - DNA, 7639 bp, Homo sapiens
ccggcagccagccaggaggacgggcccgcccgcgcgctactcggagcccagcctcgttgcggccatcgccctgccggaccgcgcctcaggctcccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggctgagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaacgcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggt

SEQ ID NO: 221 - DNA, 1818 bp, Homo sapiens
tgggtgggggacgccaccgctgggacagggactcgggactctgctcaccacgtagggctgctggggacacagcccaaggagttccctctgtctggcccacatcctcccaggcccttccatggactgaccagggtcctgggtgccagaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagtgagtgcctagagggaggcaggagccgtccagcaggggcggggctgtcacgttcctcttgttcttccctagtgtgagtagtcatccaggtaaatcattagccgtctttgaggtcatgagtcacccagggtctgtctaggcatttttctgtcattaaatacgtcctgggaaccacataggaactcttagcatttgtttgcaaggctatttttcttagaaatcagt

SEQ ID NO: 222 - DNA, 1850 bp, Homo sapiens
aagttttctgtaaagacggggtcttgctaccttgtccaggatggtctcaaactcctgggctcaagcgatcttcctgctttggcctcccaaagtgctgggaatacaggcatgagccaccgcgacaggccatgttgctgaatttggaaagtggagcaaagaatcatgcaaaaaattaagaaaaccaaaacgcaaccaaggcgaattcaattgcatttttttttcccagcgacactttctgagacacgaacctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaaggaaggtttaaaaaaaaaaaaaaaaaaaaagattacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaaggaa

SEQ ID NO: 223 - DNA, 1950 bp, Homo sapiens
aagttttctgtaaagacggggtcttgctaccttgtccaggatggtctcaaactcctgggctcaagcgatcttcctgctttggcctcccaaagtgctgggaatacaggcatgagccaccgcgacaggccatgttgctgaatttggaaagtggagcaaagaatcatgcaaaaaattaagaaaaccaaaacgcaaccaaggcgaattcaattgcatttttttttcccagcgacactttctgagacacgaacctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaaggaaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaaggaa

SEQ ID NO: 224 - DNA, 621 bp, Homo sapiens
caaatggcggatgacgccggtgcagcgggggggcggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgt

SEQ ID NO: 225 - DNA, 907 bp, Homo sapiens
aattgcttcttttccgagaaaacaacaaatggcggatgacgccggtgcagcgggggggcacggaggccctggtggccctgggatggggaaccgcggtggcttccgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtgaaaaaaaaattataaaagaatttataccagaatat

SEQ ID NO: 226 - DNA, 728 bp, Homo sapiens
caacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgcatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtga

SEQ ID NO: 227 - DNA, 895 bp, Homo sapiens
acaacaaatggcggatgacgccggtgcagcgggggggcacggaggccctggtggccctgggatggggaaccgcggtggcttccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtgaaaaaaaaattataaaagaatttataccagaatat

SEQ ID NO: 228 - DNA, 982 bp, Homo sapiens
aattgcttcttttccgagaaaacaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtgaaaaaaaaattataaaagaatttataccagaatat

SEQ ID NO: 229 - DNA, 873 bp, Homo sapiens
aaaacaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtgaaaaaaaaattataaaagaatttataccagaatat

SEQ ID NO: 230 - DNA, 798 bp, Homo sapiens
atggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaagttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtgaaaaaaaaattataaaagaatttataccagaatat

SEQ ID NO: 231 - DNA, 871 bp, Homo sapiens
acaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggagctccagctgtggctacaacatagggtttttatacaagaaaaataaagtgaattaagcgtg

SEQ ID NO: 232 - DNA, 739 bp, Homo sapiens
aattgcttcttttccgagaaaacaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgt

SEQ ID NO: 233 - DNA, 858 bp, Homo sapiens
atggcggatgacgccggtgcagcgggggggcacggaggccctggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtgaaaaaaaaattataaaagaatttataccagaatat

SEQ ID NO: 234 - DNA, 758 bp, Homo sapiens
acaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggctccagctgtggctacaacatagggtttttatacaagaaaaataaagtgaattaagcgtgaaaa

SEQ ID NO: 235 - DNA, 939 bp, Homo sapiens
atggggctcaataagtctgcttccaccttccagcttactggcttcccaggcatggagaaggcacatcactggatattcatcccattattggcagcctacatctccatacttcttggcagtggcactcttctctttctcatcaggaatgatcataacctccatgagcccatgtactatttcttagctatgttggcagctacagacctcggagtgacattgaccacaatgcccacagtgctaggtgttctgtggttagatcacagggagattggccatggagcctgcttctctcaggcctattttatccatactctttctgtcatggagtcaggtgtcttgcttgccatggcttatgactgtttcattaccatccacaaccccttaagatatacctctatcctgaccaacacccaggtaatgaagattggtgtgcgggtattgacaagggctggtctgtccattatgccaatagttgttcgcctacactggtttccctactgtcgatcccatgtactctcccatgctttctgtctacaccaagatgtcatcaagctagcctgtgctgacatcaccttcaaccgtctctatccagttgtagttttatttgcaatggtcttgttggactttctcatcatctttttctcctacattttgattctcaagactgtcatgggcattggttctggaggagaaagggccaaggccctcaacacatgtgtctctcatatctgctgcatcctggtcttctatgtcactgtagtttgtctgacatttattcataggtttggaaagcatgttcctcatgtcgttcacatcacaatgagctacatccacttccttttcccaccttttatgaacccatttatctatagcattaaaactaagcagattcagagtggcatacttcgtttattctctctgcctcactctagagcatga

SEQ ID NO: 236 - DNA, 1549 bp, Homo sapiens
ccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggcctgaggcccagccagcgcccaatggatgacaaaaagaagaaacggagtcccaagccctgcctggcccagccagcccaggccccaggcacactacggagggtccctgtgcct

SEQ ID NO: 237 - DNA, 4857 bp, Homo sapiens
ggctgaggcgggagcaggcggctggccggcagcagttactcggggtttccggtgcgaggccagaggtggggaagccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccagggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgcctt

SEQ ID NO: 238 - DNA, 5015 bp, Homo sapiens
ggttgtgccgggaagtggctccagggagaagaggcctcttccctcacccgctgtgggagctgcgccccgaaagcctgccccggcacgtcgggctctcctgacccgccaagaccagagagccgttggcgccctccgcccgggcctgccggtccgtttattttaagaagctttgtgcgcctgctgtggggatttctgatccaggctgcgaagaatttcgaagtctggaaaatagcaactgtgtttgtttctaaaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccagggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgcctt

SEQ ID NO: 239 - DNA, 2174 bp, Homo sapiens
gaggtggggaagccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatctgccctcttaggttcataggccaaagtgatgatcgtgtgtgcaggacctagagggcgctcccctgacccacccctttccttgccatacttcatcctctgggaacaaagctgcttgtttggtttgaggggagttggtttggttcttatccctcagcgctgagacatagaggcttcctgggccactacagtgagacacgaacttcaagaatctgaatacccccgttttctctccccgccaaggcaaaaaaggacttagtactacctgtggagaaggaggtgcaggactaccaggccctgctgctttgcatttacagccctccccagacagacacaggcaccctcatcatacccaaactggacttacctgctaggcaccttcccttccccatccaaaaaaatggagttattttcccttatttcagcaagtccagttgattttacctttgaagtagcacctgagtccttcaccttctctccatcccttctctctcacctgacacaggtctgcagcgctcctctagtaggcaggacagccattccttggggatgcacatgtctagtctttgcctagatatggcaagtctttgccaactgagctaggctgttatgttcttagaggcattgtttttgcccattcttcccatttacaagagaatcagggacacagaagtgagggcttccagccccataggtgatcaatcctggggtcagagatttgagtgtgtttattgcttgccttcttgggagcagattccatccataaaccatgtgcttaccaaggtctgactcactgggagagaaacgacgtgaggttggaaagctgaccttccagagacttggggcccatgttgtgtggtacacatgggagtccatcatatcagattgagatggggggctgggcaaagtgccctggtctgtggctgtggggctaccctgagaaagggagcgcctgacaagccgactgctcccaccatctttgttgcagcatatcgacaaagtcttcaaacacaaggacctacaacagcagctggtggatgccaagctccagcaggcccaggagatgctaaaggaggcagaagagcggcaccagcgggagaaggattttgtgaggctcaggccccagggttggggtgggggtgtgggaggagacaggctgggctctggctcagctcatagccgggttatatgggagaagtctggccagaccaggcacagattccttgagtaccagtctgagagcaggaagcctcagtgggtctggtgcttgtggctaaaaaccaaacatagcccctgggggcttctgacaggatctggggttctgtcttggaaatagctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaaggtaactgtggtccaggccaggcatggctgctggggcataagctgcttcattcaaaattgttgggcctgccttcaggaagctcccatctggggtgtctcaagggcagggctgttaggaaggttcacagcctttcccctcttgaggcagtatcagtggtatgtatacactccaggttgtcccagggaatggggcagtcttttctgtttgtttggtttttttggggggtttgttgttgttgttgttgttgttgttgttgtttgagatggagactcacctattg

SEQ ID NO: 240 - DNA, 2721 bp, Homo sapiens
agccggagagatcgcgcgcctgccgccgccggagcctgcgagccgagaccgtaagcgcccggggccggccgggcccgcactccccggacgcagacgcggttcgggctccgcgcgggctcggccgccggggtgggcggcgggccggggcgccgaggggtcggggctgcggtcggcccgcaggggtgcagagggacttgtagttggtccgcccccagctcctgccccggccaggagactgcgcgtgccgcctactgggggaaggagcctgcaggcgaccgcggacttctcgcagggaattccgcgtcccagactgtgggcggacgccgcagggagggaggctcgcgaccccgagagcgcaccgcgtcccctggcctgggcgagctctgcttccagggccgtggctcgctcggcggtgaaatgcacttaatttgtcacccaagtcggaacactgattttcatgcgcgtccgtgtgaagagaccaccaaacaggctttgtgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatggggccccctgtgcaagcagagctggccggcccctccttgctggcagaggcacgggaggcctgctggggatgaggccactggccagggctatgctgcaccagaccaatggcaccgcccccacccctcccagcgcaggggcagcttggagcagaggcagcactggccaccactgcgggggcaagtcagcgtcaagagagtccctgagtgagaaggcccagataagcccaggccccccaggccagcggacaggcacaggcagggcctacagaggtgccaaggccccaggccagttgtgctaggagcctggacctgctcttccacacccccatcccgcccctactgcacaggcttgtgccttggtgccccctggaggcagcagggaggaggcttctcaggcagaagtcttaagttgcatcccattccccagaatccccaggagggagaagagggatgggctgcccctccttcctgccagagccacagctcaagggcagtgggatggccctgcacccagcccaggtaccccttcctctgtgccgaccatgctgtcctttggctccgaggaggccctgagcactgcccacccccacacc

SEQ ID NO: 241 - DNA, 2242 bp, Homo sapiens
gcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatggggccccctgtgcaagcagagctggccggcccctccttgctggcagaggcacgggaggcctgctggggatgaggccactggccagggctatgctgcaccagaccaatggcaccgcccccacccctcccagcgcaggggcagcttggagcagaggcagcactggccaccactgcgggggcaagtcagcgtcaagagagtccctgagtgagaaggcccagataagcccaggccccccaggccagcggacaggcacaggcagggcctacagaggtgccaaggccccaggccagttgtgctaggagcctggacctgctcttccacacccccatcccgcccctactgcacaggcttgtgccttggtgccccctggaggcagcagggaggaggcttctcaggcagaagtcttaagttgcatcccattccccagaatccccaggagggagaagagggatgggctgcccctccttcctgccagagccacagctcaagggcagtgggatggccctgcacccagcccaggtaccccttcctctgtgccgaccatgctgtcctttggctccgaggaggccctgagcactgcccacccccacacc

SEQ ID NO: 242 - DNA, 2495 bp, Homo sapiens
ctgacttggcaggactgtgcaattgtcagaaggccgtggggagtgggggccagtgcctgcagcctgccctgcctctctcacaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatggggccccctgtgcaagcagagctggccggcccctccttgctggcagaggcacgggaggcctgctggggatgaggccactggccagggctatgctgcaccagaccaatggcaccgcccccacccctcccagcgcaggggcagcttggagcagaggcagcactggccaccactgcgggggcaagtcagcgtcaagagagtccctgagtgagaaggcccagataagcccaggccccccaggccagcggacaggcacaggcagggcctacagaggtgccaaggccccaggccagttgtgctaggagcctggacctgctcttccacacccccatcccgcccctactgcacaggcttgtgccttggtgccccctggaggcagcagggaggaggcttctcaggcagaagtcttaagttgcatcccattccccagaatccccaggagggagaagagggatgggctgcccctccttcctgccagagccacagctcaagggcagtgggatggccctgcacccagcccaggtaccccttcctctgtgccgaccatgctgtcctttggctccgaggaggccctgagcactgcccacccccacacc

SEQ ID NO: 243 - DNA, 2059 bp, Homo sapiens
cgcctgccgccgccggagcctgcgagccgagaccggaattccgcgtcccagactgtgggcggacgccgcagggagggaggctcgcgaccccgagagcgcaccgcgtcccctggcctgggcgagctctgcttccagggccgtggctcgctcggcggtgaaatgcacttaatttgtcacccaagtcggaacactgattttcatgcgcgtccgtgtgaagagaccaccaaacaggctttgtgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatggggccccctgtgcaagcagagctggccggcccctccttgctggcagaggcacgggaggcctgctggggatgaggccactggccagggctatgctgcaccagaccaatggcaccgcccccacccctcccagcgcaggggcagcttggagcagaggcagcactggccaccactgcgggggcaagtcagcgt

SEQ ID NO: 244 - DNA, 3237 bp, Homo sapiens
ctcacctgcctcacctggctgctgtctgtttccaggaagagggcatcagtgggcgaaaacaggaaaatcatcctgtgcttccaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttc

SEQ ID NO: 245 - DNA, 3294 bp, Homo sapiens
aatccgctgctgccggcgtcgggtgcgctcggcctcgcccgcggccctccttccccggcttccgctcgccgctcgttcactccacgcgccgctgccgccgccgccgccgtcgtgccgtgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttc

SEQ ID NO: 246 - DNA, 777 bp, Homo sapiens
gttttggcaaacgtctaatgacacagagccaccattgccaatttcaccactgtctttcaccaagttgattcattttgaactggctccagcaatctactcagagttgacctcagagcaaaaaattgaagtggcaacagctccatatgttgatgtgaactgtgactccaggagaacggtggaaaagtgtcttgatccaggaaggaaggggtatagagaaaatatgagtctcaccacactagaagcaacatatgcaaaatccatcaaacacaccataaaatcaatgtgggagtaacaacaccttggcctactgctccctgaaaagtttttctctcgtcaagtgatgacaggcgtacatttgtaaataaattaccaagttgcttttgatttgatggagaaggaagaaaaggattgtctcctggaagtatttttattgtcttaataggtaggataatatctctgttcagcaaactgagatcttttgagaatcttaacaaatgtatacccctccctctcaccttttcctctctggtgtatttcataggcagctttgctaactgactgcactactacaaatagattctgtcactttagaaataggatttttccttttataggcagattgatggactaagtgtcaaggttttagaacagtagcatgactggggcagacactataaaccataaatccagtattgacaaatgttctagccaatccagattttctatttgttaaattgcctttatgaagtcatacttgtgcagcacagaatatggaaa

SEQ ID NO: 247 - DNA, 385 bp, Homo sapiens
gttttggcaaacgtctaatgacacagagccaccattgccaatttcaccactgtctttcaccaagttgattcattttgaactggctccagcaatctactcagagttgacctcagagcaaaaaattgaagtgggaagctgctaaagaatgtgcttgactaaaacaaggcaataagcaaaaggaagtcatagcatccagaaaatgggatccatcatgcgcacaaagaaaaggtgaagaaaatttccaggatgttcagaacccaccaaaaacgaaagattctggtccagatcagaagagagggaaacactctgaaaaagtccctcaaatacaaaattaaacagagtttaaatgatgtgcttgaccacaataaaaggcttcttgctctgt

SEQ ID NO: 248 - DNA, 6565 bp, Homo sapiens
gtacaatccaagtctgtcgctgcccaggatagaggagggatgacgtgaattcacacgggcctctcctacaaatctgagtgtacatcaagtgaggggcgtccctccgcacctcactgttgggctgatcaatcccattcccactccattatgtgtgtatttctaagtggcagatttgccttaggaaatggaagaaggggatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaacgcttttaccatggctaaaccattaggccggctctgcagggagggcaagaccacagcagctcagtatttcctgctcagggaaaaaggccaggtcttttgttggtggaaatccacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagaggtttcccattggccacttggggtacaccccttataaatgaagtggtggcctgcaatcagtcttattggttgcagaaagcaaccaatcagaggctgaagtgaagttacaaatatcacactcctatgcaaacatctgattggttgcaaaaagcaaaaccactcagaggtactttcaatttcccatctgccctgcagaaaaggtaaggggttgcaaaagagtagcccctcctccttttgttacttaggcgtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagattccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcaattacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggatggggagcaggtaattatgctgggacaataggcgtatgtcaagatatctggtcaccctatctatgatctgtcacacttagtactttctaaaattctcgggcctttgcaccttctttttatcaacgcttagttctatgttactgaatatttcttaattaagtgcaggaaagaaaataaccattttttctccttttaaagaagcacacacacctttcttttattggtattacattccttttccctgttggtgcccctgttggttttccaaattgtcttcccatccttgtcctacctcccaatagagtacctcatcctatagtgttattataactacagaaaatatattttcattccttccacttcatgctttcagctagaaatgtgagtctctgagacttgtattcttggggtcacttaaaacatactgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtgcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaagtgctgggattagatgcatgagccacctggcccagccagaatccttccattaataaaaggatggaccatgaactcccttttatgatatgagccgatcaaatgtgagcagaatagtatcctatttatacaatgtagtttaaaaccaacttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgacgcatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaataatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagccccgcaaagacgagggagcagcaagttccaaagcccgtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccctatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgaggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagagtgaaactctgtctcgg

SEQ ID NO: 249 - DNA, 2159 bp, Homo sapiens
ctaggaagaaatctttaatttctattcagctttaaagagtttgagagcgttttttcccctctgttaacaaacgagttcaagtacatgccttcatattataaaagtacctgaaattgcctagaatagcagcatgcataaatgcaaactttgaaaaagacatacctttgtaactttctatgctaaggtgttgcataatcaaggttaatttttgtttgtttctagtctatgggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaacagcttgtttgtggttcgtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagttggaaaatttcagtgacatgccatcagatttgttccatgtagaaggacgacactatcagttagatgcttattttgttggcaaatttctatggcacttctgcttggctatttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataatagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgacagcgtaccaaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctctt

SEQ ID NO: 250 - DNA, 499 bp, Homo sapiens
actgcagagagaacatggtcctgctaacaccttgatttcaacttatataccccagaactgtgggggatatagatttctcttgttgttaaccacccagtttgcggcactttgttacagtagtgtgaaaaaagtaatataacatgcaattgaaataattatggatgctacataaagcaagagatttggataaagaaatggcagtggcaaggagggcaaatggatttctgctgtatttagaatgccacggtaaaaactttgtatttattaggtatggagaatgagagggaagtgaaggctgatccccagtttctggcttggacaactgtgaagatagtgccttttgctgagatggagaatattagaagaggagaaatttgagggaagggaaatgccaattttaattcagccttctcttatgtttgaaatacatgtgagaaaagtaaaacaacacaccagtagtgctgtaatgaaaataaaggccatagactcaaaatgtaat

SEQ ID NO: 251 - DNA, 671 bp, Homo sapiens
agccccgggaggtgcagggcccagtctgcccatctcgaccccagtgctctcctgccaggctgccctccggcccggccccaggtccatcttcatgtactcctcagtgccagtctcttcctctctgggagctggctggagctgggatggacacctgacagaaggaaattaaaattttaagggctaattccccttcattcaagaaatatttactgtgatgaagacatgttccatgcagaggaaatggccaatgcaaagagcccctgactggagggcatttggcacattctaggagagtgaggaggattctatgggccaggaattcagacagggcacagtgttgatggcttgtctgtgtcctggctgggatggctcaaatggttgtgggactatttgacttgaaaggctggagcctggaatcatttgaaacattgttcactcatgtgtctggcacctgcgttagaatgactgaaggctacatcaactagagtacttacatccggtctctccatgtgacttggacttttcacagcgtggaggctggatttcaaaggtcaactgagaatggcagaggactcatcccacctttgccacatggtgacttgccccactcccccaggtgaccttgctcgtgcatgtggatatttgctcagattaagaatgtttcccacaaa

SEQ ID NO: 252 - DNA, 328 bp, Homo sapiens
tcaagggtatatgagtagctgcgctctctactagaacctccaagcaagcgctcaggaattggcaacacggagaagcttcttgagctcagtgtgattatggcagaaactctgaagctaaagaaacttcccatgttgctgtggtcacagctcaaggggacatgaagaaacctttaaggatggaggtgtgtctactgtcttcatcctggtgatgctttcataggtatggacacaatatcaaaatgtattcaattgtacaccctagaaatgtgcactttattgtgtatatattatacctaaataaagctgttttttaaaaaacaaaaaccta

SEQ ID NO: 253 - DNA, 1301 bp, Homo sapiens
atgttgagaaggaacaacatgatctaagtctttagaaaccaagagccacgactagctgaggacacaagaattttcacaaaacaaagtagagtgattccatagatcactattatagctgcattaccagtcctaggacagaatatggatgctgaaaaatgattctttcaaagtgctgagttgttgcctcacgcccagttgtctggcatctcttcactgaaactattacagttagatctcatctctatgggtggaaggaaaaaattctgagaatgatatagtcgaagtgataccttgaaggtagaactgtgcactgtggtaataacagaaacagaaagacgacatttcttctatataaacccaggatgtcgtccagcagcagctcccatcccttcctattgactggttttccaggcttggaggaagctcatcactggatttccgtatttttcttgttcatgtatatatccatcctttttggcaatggcaccctccttcttctcattaaggaagatcacaatcttcatgagcccatgtacttctttctggccatgctggctgccacagacctggggctggccctgaccacaatgcccacggtgctgggagtcctctggctggatcacagggagattggaagtgcggcctgcttttcccaggcctactttatacactcactttcctttctcgagtctggcattctgcttgccatggcctatgaccgttttattgccatctgcaaccctcttagatatacctctgtacttactaatactcgagtagtgaagattgggctgggagttctgatgaggggatttgtatccgttgttcccccaatcaggcccctctatttttttctgtattgtcactcccatgttctttcacatgcattctgccttcaccaggatgtcattaaactcgcctgtgctgataccaccttcaaccgactgtacccagctgtgcttgtagtctttatatttgtgctggattatctgattatcttcatctcctatgtgttgatactcaagactgtcctgagcattgcctccagagaggagagggccaaggctctcattacctgtgtctcccatatctgctgtgtcctggttttttatgtcacagtgattggattgtctctgattcatcgttttggaaagcaggttccacatattgttcacctcattatgagctatgcctattttctgttccctccactaatgaatcctataacatatagtgtcaagaccaagcagattcagaatgccattcttcacctttttactacccatagaattggaacctga

SEQ ID NO: 254 - DNA, 335 bp, Homo sapiens
caagatatgccagctgcaatgaagagaagccctgtttcagttcgtggattacagactgcaacatccatcagcatcaagacaaacaccttcaaactactgtccttggcgtccagcctaacagatctgaggaatgtgataaaggaacactggattcccaaggtctgctcaggtttccttccataacaagaagtagccaaatacagctgaacaggcctgctgaaaccactgatttctttcgtttaagttcagaggttcgtaacctgctcaatggtttaaacaacaacaacaagcagtatcggaagtcagcatcatctactcagcagcccaaatctgga

SEQ ID NO: 255 - DNA, 893 bp, Homo sapiens
ggaattgggaagaaggataaatacatacatggaggagcaatagaagtctaccttatggagcatgtggaaatatcaggtggcttcttcaaatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttgcctaagttatatatttttttggcctttcccttttgatgtgacaataa

SEQ ID NO: 256 - DNA, 954 bp, Homo sapiens
atagctgccgctaatggagttggactcatgagtgagggagaaagtgcctgtgaatgacatcattatgcgacatcataggacagttttttttttcttttattcactcgtctttcttttatttcaactgatgatatcaggtggcttcttcaaatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttgcctaagttatatatttttttggcctttcccttttgatgtgacaataa

SEQ ID NO: 257 - DNA, 977 bp, Homo sapiens
tattccgtgatattgaataagtctcacaagatctggtgggtttatcaggggtttctgcttttgcttcttcctcagtttctcttgctgccaccgtgtaagaaggaccttttgcctcccaccatgattctaaggcctccccagccacgtggaactatatcaggtggcttcttcaaatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttgcctaagttatatatttttttggcctttcccttttgatgtgacaataa

SEQ ID NO: 258 - DNA, 2179 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaaacaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcattcacaacagagtgaaaaatcttaagtaccaatgggaagcagggaattcctggggtaaagtatcacttttctggggctgggctaggcataggtctctttgctttctggtggtggcctgtttgaaagtaaaaacctggttggcgtgtaggttccgtatctccctggagaagcaccagcaattctctttcttttactgttatagaatagcctgaggtcccctcgtcccatccagctaccaccacggccaccactgcagccaggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattg

SEQ ID NO: 259 - DNA, 735 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggaaaacaaaataccaccctccgccagaaaagtgcagaataaaaattttccactagcaaaagaaggaaaaaataaaagatcttgaatagtctcatc

SEQ ID NO: 260 - DNA, 1241 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaaacaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtttcagactgcctggtagaaggaggtcacttctgattgtcagtgactttggtgagttct

SEQ ID NO: 261 - DNA, 524 bp, Homo sapiens
tcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgc

SEQ ID NO: 262 - protein, 1464 aa, Homo sapiens [sequence omitted]

SEQ ID NO: 263 - protein, 564 aa, Homo sapiens
MPWAMIWDFTEPVCRGCVNYEGADRVEFVIETARQLKRAHGCFPEGRSPPGAAASAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 264 - protein, 2871 aa, Homo sapiens
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 265 - protein, 339 aa, Homo sapiens
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQRIYSSLPVEVPLNHKRFVCDLTQADRLALYDFVVEETKKKRSDSQIIENDSDLFVDLAAKINQDNSRKSPKSYLEILAEVRDYKRRRQSYRAKNVHITKKSYTEVIRDVINVHMEELSNHWQEEQEKAEDDAEKNEERRSASVDSRQSGGSYLDAECSRHRRDRSRSPHKRKRNKDKDKNCESRRRKERDGERHHSHKRRKQKI

SEQ ID NO: 266 - protein, 144 aa, Homo sapiens
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQIIGVSIKRN

SEQ ID NO: 267 - protein, 352 aa, Homo sapiens
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQRIYSSLPVEVPLNHKRFVCDLTQADRLALYDFVVEETKKKRSDSQIIENDSDLFVDLAAKINQDNSRKSPKSYLEILAEVRDYKRRRQSYRAKNVHITKKSYTEVIRDVINVHMEELSNHWQEEQEKAEDDAEKNEERRSASVDSRQSGGSYLDAECSRHRRDRSRSPHKRKRNKDKDKNCESRRRKESQVWWFAPEIQLLGRLRQESLESGRRRLQ

SEQ ID NO: 268 - protein, 714 aa, Homo sapiens [sequence omitted]

SEQ ID NO: 269 - protein, 222 aa, Homo sapiens
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGVGIFTAFLFKSIEFFIGFIVISVILHFVFQNFPLLFSCLMSIRIVDNRLLTLVIVN

SEQ ID NO: 270 - protein, 2228 aa, Homo sapiens [sequence omitted]

SEQ ID NO: 271 - protein, 3377 aa, Homo sapiens [sequence omitted]

SEQ ID NO: 272 - protein, 3841 aa, Homo sapiens [sequence omitted]

SEQ ID NO: 273 - protein, 152 aa, Homo sapiens [sequence omitted]

SEQ ID NO: 274 - protein, 128 aa, Homo sapiens
MSLVIPEKFQHILRVLNTNIDGRRKIAFAITAIKGVGRRYAHVVLRKADIDLTKRAGELTEDEVERVITIMQNPRQYKIPDWFLNRQKDVKDGKYSQVLANGLDNKLREDLERLKKIRAHRGLRHFWG

SEQ ID NO: 275 - protein, 82 aa, Homo sapiens
MQNPRQYKIPDWFLNRQKDVKDGKYSQVLANGLDNKLREDLERLKKIRAHRGLRHFWGLRVRGQHTKTTGRRGRTVGVSKKK

SEQ ID NO: 276 - protein, 144 aa, Homo sapiens
MSLVIPEKFQHILRVLNTNIDGRRKIAFAITAIKGVGRRYAHVVLRKADIDLTKRAGELTEDEVERVITIMQNPRQYKIPDWFLNRQKDVKDGKYSQVCTEMRAGLEEGWRVLTELGIGGQGIKHPLPPPLNPGPSQWSGQQAP

SEQ ID NO: 277 - protein, 82 aa, Homo sapiens; identical to SEQ ID NO: 275

SEQ ID NO: 278 - protein, 82 aa, Homo sapiens; identical to SEQ ID NO: 275

SEQ ID NO: 279 - protein, 82 aa, Homo sapiens; identical to SEQ ID NO: 275

SEQ ID NO: 280 - protein, 74 aa, Homo sapiens
MSVLAPKIGPLGMSAKKVGDDTAKATGDWKGLRIIVKLTIQNRPRVRWYHLPLPEGFLQSPQGTTKRWKETEKH

SEQ ID NO: 281 - protein, 149 aa, Homo sapiens [sequence omitted]

SEQ ID NO: 282 - protein, 448 aa, Homo sapiens [sequence omitted]

SEQ ID NO: 283 - protein, 49 aa, Homo sapiens
MRLDDHVLAQGEAGVAWVGKGLQRDLGGDRGLKEGWVELVQLQDSQAGF

SEQ ID NO: 284 - protein, 453 aa, Homo sapiens
MKIFKCYFKHTLQQKVFILFLTLWLLSLLKLLNVRRLFPQKDIYLVEYSLSTSPFVRNRYTHVKDEVRYEVNCSGIYEQEPLEIGKSLEIRRRDIIDLEDDDVVAMTSDCDIYQTLRGYAQKLVSKEEKSFPIAYSLVVHKDAIMVERLIHAIYNQHNIYCIHYDRKAPDTFKVAMNNLAKCFSNIFIASKLEAVEYAHISRLQADLNCLSDLLKSSIQWKYVINLCGQDFPLKSNFELVSELKKLNGANMLETVKPPNSKLERFTYHHELRRVPYEYVKLPIRTNISKEAPPHNIQIFVGSAYFVLSQAFVKYIFNNSIVQDFFAWSKDTYSPDEHFWATLIRVPGIPGEISRSAQDVSDLQSKTRLVKWNYYEGFFYPSCTGSHLRSVCIYGAAELRWLIKDGHWFANKFDSKVDPILIKCLAEKLEEQQRDWITLPSEKLFMDRNLTTTS

SEQ ID NO: 285 - protein, 634 aa, Homo sapiens
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPTPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSKRESPGVGGGSGDEASAATPPSSRRVWSPPRVHKVEMGFGGGGGAN

SEQ ID NO: 286 - protein, 435 aa, Homo sapiens
MWAPPAAIMGDGPTKKVGNQAPLQTQALQTASLRDGPAKRAVWVRHTSSEPQEPTESKAAKERPKQEVTKAVVVDLGTGYCKCGFAGLPRPTHKISTTVGKPYMETAKTGDNRKETFVGQELNNTNVHLKLVNPLRHGIIVDWDTVQDIWEYLFRQEMKIAPEEHAVLVSDPPLSPHTNREKYAEMLFEAFNTPAMHIAYQSRLSMYSYGRTSGLVVEVGHGVSYVVPIYEGYPLPSITGRLDYAGSDLTAYLLGLLNSAGNEFTQDQMGIVEDIKKKCCFVALDPIEEKKVPLSEHTIRYVLPDGKEIQLCQERFLCSEMFFKPSLIKSMQLGLHTQTVSCLNKCDIALKRDLMGNILLCGGSTMLSGFPNRLQKELSSMCPNDTPQVNVLPERDSAVWTGGSILASLQGFQPLWVHRFEYEEHGPFFLYRRCF

SEQ ID NO: 287 - protein, 395 aa, Homo sapiens [sequence omitted]

SEQ ID NO: 288 - protein, 395 aa, Homo sapiens [sequence omitted]

SEQ ID NO: 289 - protein, 318 aa, Homo sapiens
MSTHVAGLGLDKMKLGNPQSFLDQEEADDQQLLEPEAWKTYTERRNALREFLTSDLSPHLLKRHHARMQLLRKCSYYIEVLPKHLALGDQNPLVLPSALFQLIDPWKFQRMKKVGTAQTKIQLLLLGDLLEQLDHGRAELDALLRSPDPRPFLADWALVERRLADVSAVMDSFLTMMVPGRLHVKHRLVSDVSATKIPHIWLMLSTKMPVVFDRKASAAHQDWARLRWFVTIQPATSEQYELRFRLLDPRTQQECAQCGVIPVAACTFDVRNLLPNRSYKFTIKRAETSTLVYEPWRDSLTLHTKPEPLEGPALSHSV

SEQ ID NO: 290 - protein, 99 aa, Homo sapiens
MCQVEFELRGPQAAEGSRERSGEAAGLRLVQTGHPGRLRHPRPSGLRRESQGQVGGLEREKRGVQDGRHEGLRGQSGGADEEGSGGRGARTKGRARWTP

SEQ ID NO: 291 - protein, 231 aa, Homo sapiens [sequence omitted]

SEQ ID NO: 292 - protein, 760 aa, Homo sapiens [sequence omitted]

SEQ ID NO: 293 - protein, 740 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 294 - protein, 387 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGTTGARHHARLTFCVFSRDGVSPC

SEQ ID NO: 295 - protein, 141 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPAAKHDIVLTS

SEQ ID NO: 296 - protein, 412 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGKSWELCGI

SEQ ID NO: 297 - protein, 448 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 298 - protein, 299 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYSELGDRGLQG

SEQ ID NO: 299 - protein, 448 aa, Homo sapiens; identical to SEQ ID NO: 297

SEQ ID NO: 300 - protein, 337 aa, Homo sapiens
MLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 301 - protein, 777 aa, Homo sapiens
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 302 - protein, 399 aa, Homo sapiens [sequence omitted]

SEQ ID NO: 303 - protein, 777 aa, Homo sapiens; identical to SEQ ID NO: 301

SEQ ID NO: 304 - protein, 148 aa, Homo sapiens
MAVASDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 305 - protein, 82 aa, Homo sapiens
MLTLCRSNLSLLLKEALFRKAKELEIVIGDEHISFTTSKIGSLIDVNQSKDPEGLRVFYYLVQDLKCLVFSLIGLHFKIKPI

SEQ ID NO: 306 - protein, 91 aa, Homo sapiens
MAVASDFYLRYYVGHKGKFGHEFLEFEFRPDGKLRYANNSNYKNDVMIRKEAYVHKSVMEELKRIIDDSEITKEDDALWPPPDRVGRQVCI

SEQ ID NO: 307 - protein, 115 aa, Homo sapiens
MMFLRLLKNSEGLISLCKKKVWFLNWVFSTLGEIPSTTPGRKKHLISLLYIPEDCELEIVIGDEHISFTTSKIGSLIDVNQSKDPEGLRVFYYLVQDLKCLVFSLIGLHFKIKPI

SEQ ID NO: 308 - protein, 292 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 309 - protein, 363 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRLAGWVCFGLSPSVAPEEGETEARQSDSTLKQNRKHPGTVQKSQKKSASLRWKDIINDQRAFSLSVQTKTLCI

SEQ ID NO: 310 - protein, 258 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDGSLHSNPLLPLPVVRTNDYPEQGGGVWERNQPYWFWFLYFSQ

SEQ ID NO: 311 - protein, 1369 aa, Homo sapiens [sequence omitted]

SEQ ID NO: 312 - protein, 967 aa, Homo sapiens [sequence omitted]

SEQ ID NO: 313 - protein, 941 aa, Homo sapiens
MCLNYEVRVLCCETPRGCPVTSVTPYGTSPTNALYPSLSTSMVSASVASTSVASSSVASSSVAYSTQTCFCNVADRLYPAGSTIYRHRDLAGHCYYALCSQDCQVVRGVDSDCPSTTLPPAPATSPSISTSEPVTELGCPNAVPPRKKGETWATPNCSEATCEGNNVISLRPRTCPRVEKPTCANGYPAVKVADQDGCCHHYQCQCVCSGWGDPHYITFDGTYYTFLDNCTYVLVQQIVPVYGHFRVLVDNYFCGAEDGLSCPRSIILEYHQDRVVLTRKPVHGVMTNEIIFNNKVVSPGFRKNGIVVSRIGVKMYATIPELGVQVMFSGLIFSVEVPFSKFANNTEGQCGTCTNDRKDECRTPRGTVVASCSEMSGLWNVSIPDQPACHRPHPTPTTVGPTTVGSTTVGPTTVGSTTVGPTTPPAPCLPSPICQLILSKVFEPCHTVIPPLLFYEGCVFDRCHMTDLDVVCSSLELYAALCASHDICIDWRGRTGHMCPFTCPADKVYQPCGPSNPSYCYGNDSASLGALPEAGPITEGCFCPEGMTLFSTSAQVCVPTGCPRCLGPHGEPVKVGHTVGMDCQECTCEAATWTLTCRPKLCPLPPACPLPGFVPVPAAPQAGQCCPQYSCACNTSRCPAPVGCPEGARAIPTYQEGACCPVQNCSWTVCSINGTLYQPGAVVSSSLCETCRCELPGGPPSDAFVVSCETQICNTHCPVGFEYQEQSGQCCGTCVQVACVTNTSKSPAHLFYPGETWSDAGNHCVTHQCEKHQDGLVVVTTKKACPPLSCSLDEARMSKDGCCRFCPPPPPPYQNQSTCAVYHRSLIIQQQGCSSSEPVRLAYCRGNCGDSSSMYSLEGNTVEHRCQCCQELRTSLRNVTLHCTDGSSRAFSYTEVEECGCMGRRCPAPGDTQHSEEAEPEPSQEAESGSWERGVPVSPMH

SEQ ID NO: 314 - protein, 530 aa, Homo sapiens [sequence omitted]

SEQ ID NO: 315 - protein, 941 aa, Homo sapiens; identical to SEQ ID NO: 313

SEQ ID NO: 316 - protein, 206 aa, Homo sapiens
MKGLMSVCTPALGGVEWGAGYRPNLSTWLNHSSFEMQKPKRSSAHTSRKPVTAGDAYGPASPITKSLQSYDNLTGSRTPHPELRGEHMALDGPIGDGLMTQSQDFHLYNGGTAGSQGQCWWNTVNRDLFGFWNNKKGTVHGYFQAGTEALSRRRQPYPQEMIENVRTILSLQAIAKETTARTKIGKVTHPLQKKNMQNKSKNTNHD

SEQ ID NO: 317 - protein, 223 aa, Homo sapiens
MRGQVRASWNQAGTRSPRSGEVMQICRPWGQEHIKPLGADAFSIPNSSMLERYFGPDLFGFWNNKKGTVHGYFQAGTEALSRRRQPYPQEGSDEPAWQACFPPPDNSKDQDWQSDTSSPKEEHAEQIKEHKPRLTNTATLDFKNLTCAEDESPRPAQHTELFIPIPPYITPPSPVWRQPPETALGAPEALRSPGLVTQAPNTLSLIGYYSFFMKPSRLSPSSL

SEQ ID NO: 318 - protein, 481 aa, Homo sapiens [sequence omitted]

SEQ ID NO: 319 - protein, 103 aa, Homo sapiens [sequence omitted]

SEQ ID NO: 320 - protein, 1428 aa, Homo sapiens
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 321 - protein, 637 aa, Homo sapiens
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 322 - protein, 395 aa, Homo sapiens
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTARSSNAARSLRAALTWTWRLTYTFTPIIFISCVVHS

SEQ ID NO: 323 - protein, 1052 aa, Homo sapiens
MLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLGKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 324 - protein, 1419 aa, Homo sapiens
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLGKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 325 - protein, 1061 aa, Homo sapiens
MLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 326 - protein, 432 aa, Homo sapiens
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 327 - protein, 241 aa, Homo sapiens
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSMYPFQGTRLCVCVPERSVSSSPALQEYSHTTNFPTSCSPVRFSHRLPKPRYRNLEFPQN

SEQ ID NO: 328 - protein, 912 aa, Homo sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 329 - protein, 879 aa, Homo sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 330 - protein, 898 aa, Homo sapiens
MRKGVLKDPEIADLFYKDDPEELFIGLHEIGHGSFGAVYFATNAHTNEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 331 - protein, 438 aa, Homo sapiens
MSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 332 - protein, 85 aa, Homo sapiens
RPREGPCGAGRRGPAWRVGRNAETASRGCAQPDPALSDRTQGSAGEQATGERLRNKCGRGSGGGGAGPGGGDSRSEVGCIINTKD

SEQ ID NO: 333 - protein, 898 aa, Homo sapiens; identical to SEQ ID NO: 330

SEQ ID NO: 334 - protein, 96 aa, Homo sapiens [sequence omitted]

SEQ ID NO: 335 - protein, 128 aa, Homo sapiens [sequence omitted]

SEQ ID NO: 336 - protein, 55 aa, Homo sapiens
CAIRVSSFTLLSHPLARLENAKKKKRKTPGFCILLDEGYKVPDTAYDRDLINGGC

SEQ ID NO: 337 - protein, 181 aa, Homo sapiens [sequence omitted]

SEQ ID NO: 338 - protein, 1242 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 339 - protein, 1242 aa, Homo sapiens; identical to SEQ ID NO: 338

SEQ ID NO: 340 - protein, 1678 aa, Homo sapiens [sequence omitted]

SEQ ID NO: 341 - protein, 1678 aa, Homo sapiens [sequence omitted]

SEQ ID NO: 342 - protein, 129 aa, Homo sapiens
MEPNHPFYSNISKDRRYADLTEDLLPSCESLKDTIARALTFWNEEIVPQIKEGKRVLIAAHGNSLRGIAKHLEGLSEEAIMELNLPTGIPIVYEWDKNLKPIKPMQFLGDEEMVRKAMEAVAAQGKAKK

SEQ ID NO: 343 - protein, 131 aa, Homo sapiens [sequence omitted]

SEQ ID NO: 344 - protein, 408 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 345 - protein, 408 aa, Homo sapiens; identical to SEQ ID NO: 344

SEQ ID NO: 346 - protein, 408 aa, Homo sapiens; identical to SEQ ID NO: 344

SEQ ID NO: 347 - protein, 408 aa, Homo sapiens; identical to SEQ ID NO: 344

SEQ ID NO: 348 - protein, 227 aa, Homo sapiens
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKSCIDSWFEVNRSCPEHPAD

SEQ ID NO: 349 - protein, 495 aa, Homo sapiens
MARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKAGVTHRLPSDQGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 350 - protein, 202 aa, Homo sapiens
MMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 351 - protein, 507 aa, Homo sapiens
MARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRFGFWPEIPHHTAWYSPCVSLGRRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 352 - protein, 296 aa, Homo sapiens
MTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKSDLVRCREVSVSEGRACAVVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 353 - protein, 705 aa, Homo sapiens [sequence omitted]

SEQ ID NO: 354 - protein, 710 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 355 - protein, 713 aa, Homo sapiens [sequence omitted]

SEQ ID NO: 356 - protein, 713 aa, Homo sapiens [sequence omitted]

SEQ ID NO: 357 - protein, 206 aa, Homo sapiens
MEISVKELRTILNRIISKHKDLRTKGFSLESCRSMVNLMDVSFRLLLSPEWGFGWSPKSTCRLGGHLPFCTVAHSPMTGLSDGISFLTATQRDGNGKLGLVEFNILWNRIRNYLSIFRKFDLDKSGSMSAYEMRMAIESAGFKLNKKLYELIITRYSEPDLAVDFDNFVCCLVRLETMFRECPQLPPTLQLRPKRVPQELGGMTDG

SEQ ID NO: 358 - protein, 713 aa, Homo sapiens [sequence omitted]

SEQ ID NO: 359 - protein, 710 aa, Homo sapiens; identical to SEQ ID NO: 354

SEQ ID NO: 360 - protein, 463 aa, Homo sapiens
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 361 - protein, 463 aa, Homo sapiens; identical to SEQ ID NO: 360

SEQ ID NO: 362 - protein, 463 aa, Homo sapiens; identical to SEQ ID NO: 360

SEQ ID NO: 363 - protein, 2542 aa, Homo sapiens
MAVWEAEQLGGLQRGDLLTPPAPDGDGRTAPLGQPPGAQLYCPACLVTCHSQEAFENHCASSEHAQMVAFDQALPWEHRSPPPGLSKFELCPKPDLCEYGDACTKAHSAQELQEWVRRTQAVELRGQAAWQDGLVPYQERLLAEYQRSSSEVLVLAETLDGVRVTCNQPLMYQAQERKTQYSWTFAVHSEEPLLHVALLKQEPGADFSLVAPGLPPGRLYARGERFRVPSSTADFQVGVRVQAASFGTFEQWVVFDFGRRPVLLQKLGLQLGQGRRPGPCRNLALGHPEEMERWHTGNRHVVPGVERTAEQTALMAKYKGPALALEFNRSSVASGPISPTNYRQRMHQFLYEEEAAQQQLVAKLTLRGQVFLKTALQTPALNMLFAPPGALYAEVPVPSSLMPDTDQGFLLGRAVSTALVAPVPAPDNTVFEVRLERRASSEQALWLLLPARCCLALGLQPEARLVLEVQFQIDPMTFRLWHQAVDTLPEEQLVVPDLPTCALPRPWSVPPLRRGNRKQELAVALIAGWGPGDGRRVPPLLIYGPFGTGKTYTLAMASLEVIRRPETKVLICTHTNSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGNPDRDMSMASWLNLAEIAQVVEKVQEAYNTWPSCWGGREQRCICVVSHGAQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLRAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLPAPTASPRPGPSSLGPGLNVDPGTYTWVAHGQTQDWDQERRADRQEAPRRVHLFVHHMGMEKVPEEVLRPGTLFTVELLPKQLPDLRKEEAVRGLEEASPLVTSIALGRPVPQPLCRGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 364 - protein, 2080 aa, Homo sapiens [sequence omitted]

SEQ ID NO: 365 - protein, 505 aa, Homo sapiens
MKRTPTAEEREREAKKLRLLEELEDTWLPYLTPKDDEFYQQWQLKYPKLILREASSVSEELHKEVQEAFLTLHKHGCLFRDLVRIQGKDLLTPVSRILIGNPGCTYKYLNTRLFTVPWPVKGSNIKHTEAEIAAACETFLKLNDYLQIETIQALEELAAKEKANEDAVPLCMSADFPRVGMGSSYNGQDEVDIKSRAAYNVTLLNFMDPQKMPYLKEEPYFGMGKMAVSWHHDENLVDRSAVAVYSYSCEGPEEESEDDSHLEGRDPDIWHVGFKISWDIETPGLAIPLHQGDCYFMLDDLNATHQHCVLAGSQPRFSSTHRVAECSTGTLDYILQRCQLALQNVCDDVDNDDVSLKSFEPAVLKQGEEIHNEVEFEWLRQFWFQGNRYRKCTDWWCQPMAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 366 - protein, 1235 aa, Homo sapiens
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLRISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDVSQEGSVDEVKENTEKMQQGKDDVSLLSEGQLAEQSLASSEDETEITEDLEPEVEEDMSASDSDDCIIPGPISKNIKQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 367 - protein, 490 aa, Homo sapiens
MSEVTKNSLEKILPQLKCHFTWNLFKEDSVSRDLEDRVCNQIEFLNTEFKATMYNLLAYIKHLDGNNEAALECLRQAEELIQQEHADQAEIRSLVTWGNYAWVYYHLGRLSDAQIYVDKVKQTCKKFSNPYSIEYSELDCEEGWTQLKCGRNERAKVCFEKALEEKPNNPEFSSGLAIAMYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 368 - protein, 490 aa, Homo sapiens; identical to SEQ ID NO: 367

SEQ ID NO: 369 - protein, 399 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 370 - protein, 399 aa, Homo sapiens; identical to SEQ ID NO: 369

SEQ ID NO: 371 - protein, 399 aa, Homo sapiens; identical to SEQ ID NO: 369

SEQ ID NO: 372 - protein, 529 aa, Homo sapiens
MRQPRRPQVRGPRHPAPPPCAMEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRCLSQILHTEFKSKGLKME

SEQ ID NO: 373 - protein, 508 aa, Homo sapiens
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRCLSQILHTEFKSKGLKME

SEQ ID NO: 374 - protein, 463 aa, Homo sapiens
MRQPRRPQVRGPRHPAPPPCAMEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRCLSQILHTEFKSKGLKME

SEQ ID NO: 375 - protein, 1627 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQAVLRSLGFFVLQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 376 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 377 - protein, 839 aa, Homo sapiens
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 378 - protein, 799 aa, Homo sapiens
MELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 379 - protein, 639 aa, Homo sapiens
MPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 380 - protein, 782 aa, Homo sapiens
MKPRAFRLRSLSPSPRFHCFLLNAAVLSRRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 381 - protein, 215 aa, Homo sapiens
MNDQGEIYSTLRFLQSPSESQNRLRPDDTQRPGKTDDKEFSVPWHLIAVTLGILCLLLLMIVTVLVTNIFQCIQEKHQRQEILRNCSEKYIMQNDNYLKEQILTNKTLKYDVLKNSFQQKKELDSRLIQKNRCHRENEIVFKVLQNTGKFSEDHGSCCGVNCYYFTMQKKDWKGCKQTCQHCRSSLLKIDDKDELVFYIHFYSLGLCFSMLDLRY

SEQ ID NO: 382 - protein, 284 aa, Homo sapiens
MNDQGEIYSTLRFLQSPSESQNRLRPDDTQRPGKTDDKEFSVPWHLIAVTLGILCLLLLMIVTVLVTNIFQCIQEKHQRQEILRNCSEKYIMQNDNYLKEQILTNKTLKYDVLKNSFQQKKELDSRLIQKNRCHRENEIVFKVLQNTGKFSEDHGSCCGVNCYYFTMQKKDWKGCKQTCQHCRSSLLKIDDKDELAFIQSQIYENNYWIGLSYDERESKWKWIDNGTSPGINSTIMRFSSGRGECAFLTSTRMATIDCIQTYNCICGKRIDSIFSDSVCAKKKR

SEQ ID NO: 383 - protein, 215 aa, Homo sapiens; identical to SEQ ID NO: 381

SEQ ID NO: 384 - protein, 614 aa, Homo sapiens
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 385 - protein, 614 aa, Homo sapiens; identical to SEQ ID NO: 384

SEQ ID NO: 386 - protein, 1058 aa, Homo sapiens [sequence omitted]

SEQ ID NO: 387 - protein, 1062 aa, Homo sapiens [sequence omitted]

SEQ ID NO: 388 - protein, 1047 aa, Homo sapiens
MTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFREPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLGQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRDWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQCFLKSIAEGIGPEERRQTLLQKMSSF

SEQ ID NO: 389 - protein, 599 aa, Homo sapiens [sequence omitted]

SEQ ID NO: 390 - protein, 599 aa, Homo sapiens [sequence omitted]

SEQ ID NO: 391 - protein, 599 aa, Homo sapiens [sequence omitted]

SEQ ID NO: 392 - protein, 599 aa, Homo sapiens [sequence omitted]

SEQ ID NO: 393 - protein, 485 aa, Homo sapiens
MRSRVAVRACHKVCRCLLSGFGGRVDAGQPELLTERSSPKGGHVKSHAELEGNGEHPEAPGSGEGSEALLEICQRRHFLSGSKQQLSRDSLLSGCHPGFGPLGVELRKNLAAEWWTSVVVFREQVFPVDALHHKPGPLLPGDSAFRLVSAETLREILQDKELSKEQLVAFLENVLKTSGKLRENLLHGALEHYVNCLDLVNKRLPYGLAQIGVCFHPVFDTKQIRNGVKSIGEKTEASLVWFTPPRTSNQWLDFWLRHRLQWWRKFAMSPSNFSSSDCQDEEGRKGNKLYYNFPWGKELIETLWNLGDHELLHMYPGNVSKLHGRDGRKNVVPCVLSVNGDLDRGMLAYLYDSFQLTENSFTRKKNLHRKVLKLHPCLAPIKVALDVGRGPTLELRQVCQGLFNELLENGISVWPGYLETMQSSLEQLYSKYDEMSILFTVLVTETTLENGLIHLRSRDTTMKEMMHISKLKDFLIKYISSAKNV

SEQ ID NO: 394 - protein, 1332 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 395 - protein, 1413 aa, Homo sapiens
MATSGAATPALRDPSASSAQPGLGVLFRRTARVVRTRAALRSAALQRFPLEGASILGGLVPSEREREPRTETRAQFGADSGCGLWELTLGSRLRVAGEARPDAPLFGGPQLYLSRGNHFIMRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEGEGSILDRIPHLEEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 396 - protein, 1308 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 397 - protein, 1452 aa, Homo sapiens
MATSGAATPALRDPSASSAQPGLGVLFRRTARVVRTRAALRSAALQRFPLEGASILGGLVPSEREREPRTETRAQFGADSGCGLWELTLGSRLRVAGEARPDAPLFGGPQLYLSRGNHFIMRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 398 - protein, 908 aa, Homo sapiens
MATSGAATPALRDPSASSAQPGLGVLFRRTARVVRTRAALRSAALQRFPLEGASILGGLVPSEREREPRTETRAQFGADSGCGLWELTLGSRLRVAGEARPDAPLFGGPQLYLSRGNHFIMRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELK

SEQ ID NO: 399 - protein, 257 aa, Homo sapiens
AWHRRGRGATLAASPVPLPSCPSAQTFVFDLCFDVEPQSTVIGGGGGGGGTCGPESSARAHDTRCAPEEHAQSGLRGGSAGVPEGGGGGAGGRHGYRARSRGAGGAFARGSILHSLVQTGICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 400 - protein, 181 aa, Homo sapiens
MATEPEAAEPVVPSLVDRYFTRWYKPDVKGKFCEDHCILQHSNRICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 401 - protein, 1516 aa, Homo sapiens
MAPILSINLFIGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 402 - protein, 1515 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 403 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 404 - protein, 1532 aa, Homo sapiens; identical to SEQ ID NO: 403

SEQ ID NO: 405 - protein, 1532 aa, Homo sapiens; identical to SEQ ID NO: 403

SEQ ID NO: 406 - protein, 1518 aa, Homo sapiens
MSLLTCAFYLGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKVVLSASQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 407 - protein, 1532 aa, Homo sapiens; identical to SEQ ID NO: 403

SEQ ID NO: 408 - protein, 1535 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKVVLSASQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 409 - protein, 24 aa, Homo sapiens
MLPVYQEVKPNPLQDANLCSRVFF

SEQ ID NO: 410 - protein, 1325 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 411 - protein, 39 aa, Homo sapiens
MLPVYQEVKPNPLQDANLCSRVFFWSPPPLSWKDTCHWI

SEQ ID NO: 412 - protein, 807 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 413 - protein, 807 aa, Homo sapiens; identical to SEQ ID NO: 412

SEQ ID NO: 414 - protein, 189 aa, Homo sapiens [sequence omitted]

SEQ ID NO: 415 - protein, 416 aa, Homo sapiens
MRTPRAVVSLVAPGHWPQMVPCGAASQERASVPPPLRKETPLSLGSAAAPGPSASRQGPKPGPPAATVARQTSRVSPAPPCSLRPGLRHESAPSAASDVTARGALRGLGCTVRVTAACGGNHGCSQSSALRIQSGKPLPDGAFLSGRPGDEGSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 416 - protein, 298 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 417 - protein, 298 aa, Homo sapiens; identical to SEQ ID NO: 416

SEQ ID NO: 418 - protein, 313 aa, Homo sapiens
MAARRALHFVFKVGNRFQTARFYRDVLGMKVESCSVARLECSGAISAHCSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 419 - protein, 298 aa, Homo sapiens; identical to SEQ ID NO: 416

SEQ ID NO: 420 - protein, 420 aa, Homo sapiens
MAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 421 - protein, 208 aa, Homo sapiens
LEGRALLQVRVGVLSESCVLGLVSFPCPCSGSVRQIGRLCSRPQEWCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 422 - protein, 179 aa, Homo sapiens
MALRSQFWGFSVCRNPGCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 423 - protein, 397 aa, Homo sapiens
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRKGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 424 - protein, 397 aa, Homo sapiens; identical to SEQ ID NO: 423

SEQ ID NO: 425 - protein, 397 aa, Homo sapiens; identical to SEQ ID NO: 423

SEQ ID NO: 426 - protein, 324 aa, Homo sapiens
MEGPLSVFGDRSTGETIRSQNGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 427 - protein, 556 aa, Homo sapiens
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 428 - protein, 556 aa, Homo sapiens; identical to SEQ ID NO: 427

SEQ ID NO: 429 - protein, 894 aa, Homo sapiens [sequence omitted]

SEQ ID NO: 430 - protein, 940 aa, Homo sapiens
MNRIRKFFRGSGRVLAFIFVASVIWLLFDMAALRLSFSEINTRVIKEDIVRRERIGFRVQPDQGKIFYSSIKEMKPPLRGHGKGAWGKENVRKTEESVLKVEVDLDQTQRERKMQNALGRGKVVPLWHPAHLQTLPVTPNKQKTDGRGTKPEASSHQGTPKQTTAQGAPKTSFIAAKGTQVVKISVHMGRVSLKQEPRKSHSPSSDTSKLAAERDLNVTISLSTDRPKQRSQAVANERAHPASTAVPKSGEAMALNKTKTQSKEVNANKHKANTSLPFPKFTVNSNRLRKQSINETPLGSLSKDDGARGAHGKKLNFSESHLVIITKEEEQKADPKEVSNSKTKTIFPKVLGKSQSKHISRNRSEMSSSSLAPHRVPLSQTNHALTGGLEPAKINITAKAPSTEYNQSHIKALLPEDSGTHQVLRIDVTLSPRDPKAPGQFGRPVVVPHGKEKEAERRWKEGNFNVYLSDLIPVDRAIEDTRPAGCAEQLVHNNLPTTSVIMCFVDEVWSTLLRSVHSVINRSPPHLIKEILLVDDFSTKDYLKDNLDKYMSQFPKVRILRLKERHGLIRARLAGAQNATGDVLTFLDSHVECNVGWLEPLLERVYLSRKKVACPVIEVINDKDMSYMTVDNFQRGIFVWPMNFGWRTIPPDVIAKNRIKETDTIRCPVMAGGLFSIDKSYFFELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCKSFKWYLENVFPDLRAPIVRASGVLINVALGKCISIENTTVILEDCDGSKELQQFNYTWLRLIKCGEWCIAPIPDKGAVRLHPCDNRNKGLKWLHKSTSVFHPELVNHIVFENNQQLLCLEGNFSQKILKVAACDPVKPYQKWKFEKYYEA

SEQ ID NO: 431 - protein, 284 aa, Homo sapiens
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 432 - protein, 3256 aa, Homo sapiens [sequence omitted]

SEQ ID NO: 433 - protein, 2801 aa, Homo sapiens [sequence omitted]

SEQ ID NO: 434 - protein, 2896 aa, Homo sapiens [sequence omitted]

SEQ ID NO: 435 - protein, 302 aa, Homo sapiens [sequence omitted]

SEQ ID NO: 436 - protein, 328 aa, Homo sapiens [sequence omitted]

SEQ ID NO: 437 - protein, 317 aa, Homo sapiens
MSAAGLLAPAPAQAGAPPLESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 438 - protein, 207 aa, Homo sapiens
MSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPDIH

SEQ ID NO: 439 - protein, 664 aa, Homo sapiens
  misc_feature (664)..(664): Xaa can be any naturally occurring amino acid
MIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGX

SEQ ID NO: 440 - protein, 667 aa, Homo sapiens
MIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGSFGM

SEQ ID NO: 441 - protein, 3027 aa, Homo sapiens
METTPGLGLRSPGAPLAQNPAELLCEAGAAVAAARWDLQKHSLLIVIGDIGTESQLRAVRAHLEQGILSWNIDLSSFDLNQQLRLFITRHLAHFSSEVKGQRTLCHQSEILETIILVNPSADSISSEVHHLLSSSSAYKLLILSGQSLEPGGDLILQSGTYSYENFAQVLHNPEISQLLSNRDPGIQAFLTVSCLGEGDWSHLGLSSSQETLHLRLNPEPTLPTMDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 442 - protein, 2803 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 443 - protein, 2984 aa, Homo sapiens [sequence omitted]

SEQ ID NO: 444 - protein, 2760 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVSDSDPYS

SEQ ID NO: 445 - protein, 2803 aa, Homo sapiens; identical to SEQ ID NO: 442

SEQ ID NO: 446 - protein, 1972 aa, Homo sapiens
MDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 447 - protein, 509 aa, Homo sapiens [sequence omitted]

SEQ ID NO: 448 - protein, 161 aa, Homo sapiens [sequence omitted]

SEQ ID NO: 449 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 450 - protein, 903 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGSAVLLREEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 451 - protein, 897 aa, Homo sapiens; identical to SEQ ID NO: 449

SEQ ID NO: 452 - protein, 466 aa, Homo sapiens
MEPELLVRKVSALQACVRGFLVRRQFQSLRAEYEAIVREVEGDLGTLQWTEGRIPRPRFLPEKAKSHQTWKAGDRVANPEQGLWNHFPCEESEGEATWEEMVLKKSGESSANQGSLCRDHSSWLQMKQNRKPSQEKTRDTTRMENPEATDQRLPHSQPQLQELQYHRSHLAMELLWLQQAINSRKEYLLLKQTLRSPEAGPIREEPRVFLEHGEQACERDQSQPSAPLEDQSYRDRTTGELEQEDDSCHRVKSPHRSPGSLATTQKNIAGAKCREPCYSKSGPPSSIPSNSQALGDRLTKGPDDGRQTFGGTCLLQMKILEDQTPRGLKPRNHCPRKSRTQLSALYEDSNIKEMSPRKLDHKEPDCRTVRTQELGLSEDHIIWDGTLGGPEHSVLDLWRTKPPKGQAPTDRSSRDGTSNEPSHEGQKKQRTIPWRSKSPEILSSTKAGCTGEEQWRGRPWKTEPPG

SEQ ID NO: 453 - protein, 164 aa, Homo sapiens
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVPWTAELQLHGKGQLQTLSQKCKREASGTQSERFG

SEQ ID NO: 454 - protein, 164 aa, Homo sapiens; identical to SEQ ID NO: 453

SEQ ID NO: 455 - protein, 140 aa, Homo sapiens
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVSKTQGQQSTL

SEQ ID NO: 456 - protein, 402 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 457 - protein, 344 aa, Homo sapiens
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 458 - protein, 402 aa, Homo sapiens; identical to SEQ ID NO: 456

SEQ ID NO: 459 - protein, 170 aa, Homo sapiens
MASVRIREAKEGDCGDILRLIRELAEFEKLSDQVKISEEALRADGFGDNPFYHCLVAEILPAPGKLLGPCVVGYGIYYFIYSTWKGRTIYLEDIYVMPEYRGQGIGSKIIKKVAEVALDKGCSQFRLAVLDWNQRAMDLYKALGAQDLTEAEGWHFFCFQGEATRKLAGK

SEQ ID NO: 460 - protein, 430 aa, Homo sapiens
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 461 - protein, 30 aa, Homo sapiens
TIFSVTQGNDLTLLLLVLGNGAGCIYRAGM

SEQ ID NO: 462 - protein, 84 aa, Homo sapiens
MQKSSSTRAGDMREKDTRGCRMSSRSECGNLTSHRILSSGGSWTLQLLLYSSLPHSENQQRSELPQMTDGKYPAWSWITKLYKL

SEQ ID NO: 463 - protein, 104 aa, Homo sapiens [sequence omitted]

SEQ ID NO: 464 - protein, 144 aa, Homo sapiens
MTSYTSSTLTNEGAELVFRSLLQFFDMRQEVLDEPHAKIKKNEPHAKIKWLLHLCAFLDSGVTGWLMRCLREINTLMRETSFHVGARDVLGLVLPLVGTVVMDRSPPLSRTHVKKWELDDNILVQSVLPPHFIQSSSTFTCVIY

SEQ ID NO: 465 - protein, 3012 aa, Homo sapiens [sequence omitted]

SEQ ID NO: 466 - protein, 2597 aa, Homo sapiens
MDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 467 - protein, 2531 aa, Homo sapiens [sequence omitted]

SEQ ID NO: 468 - protein, 2597 aa, Homo sapiens; identical to SEQ ID NO: 466

SEQ ID NO: 469 - protein, 825 aa, Homo sapiens [sequence omitted]

SEQ ID NO: 470 - protein, 234 aa, Homo sapiens
  misc_feature (234)..(234): Xaa can be any naturally occurring amino acid
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYX

SEQ ID NO: 471 - protein, 338 aa, Homo sapiens
MKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVDPVTSPVLNIMVIQTETDRHITLHCLSVNGSLPINYTFFENHVAISPAISKYDREPAEFNLTKKNPGEEEEYRCEAKNRLPNYATYSHPVTMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELLTSDDLPASASQSAGTTSLSHRARP

SEQ ID NO: 472 - protein, 60 aa, Homo sapiens
  misc_feature (60)..(60): Xaa can be any naturally occurring amino acid
MRPDLIIVGEGSGGLYQDRARIEPVNSLSQKNNFQMLYLYFHSSTFYDFLNKNCFLKAYX

SEQ ID NO: 473 - protein, 821 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 474 - protein, 468 aa, Homo sapiens [sequence omitted]

SEQ ID NO: 475 - protein, 143 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSLIYTYLAIFPRADQVLQNAS

SEQ ID NO: 476 - protein, 94 aa, Homo sapiens
MKRICYTEHRTWRSGLTTQNMLCAVNIHAVLLATSRTKDRETAPRRWSMCGKDFPPGYFEESKRRLKLCFVSCMGWCWLLDVSSEHSGVKAETW

SEQ ID NO: 477 - protein, 93 aa, Homo sapiens
MVLEKIGPEHVALAPGPDLINTQQIVDTDAVRRTEHPYEGRFPELGRPVTTVSLGSEHESGDGEGPWASGPGWLSPGNPAFPRDVLVPSVLMF

SEQ ID NO: 478 - protein, 1445 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 479 - protein, 548 aa, Homo sapiens
MSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 480 - protein, 515 aa, Homo sapiens [sequence omitted]

SEQ ID NO: 481 - protein, 1566 aa, Homo sapiens
PAASQEDGPARALLGAQPRCGHRPAGPRLRLPQPEELTSSLHAFKNKAFKKSKVCGVCKQIIDGQGISCRACKYSCHKKCEAKVVIPCGVQVRLEQAPGSSTLSSSLCRDKPLRPVILSPTMEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 482 - protein, 469 aa, Homo sapiens
MSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRK

SEQ ID NO: 483 - protein, 187 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 484 - protein, 187 aa, Homo sapiens; identical to SEQ ID NO: 483

SEQ ID NO: 485 - protein, 193 aa, Homo sapiens [sequence omitted]

SEQ ID NO: 486 - protein, 268 aa, Homo sapiens
MADDAGAAGGHGGPGGPGMGNRGGFRGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 487 - protein, 147 aa, Homo sapiens [sequence omitted]

SEQ ID NO: 488 - protein, 271 aa, Homo sapiens
MADDAGAAGGHGGPGGPGMGNRGGFRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 489 - protein, 293 aa, Homo sapiens
MADDAGAAGGHGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 490 - protein, 184 aa, Homo sapiens
MPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 491 - protein, 241 aa, Homo sapiens [sequence omitted]

SEQ ID NO: 492 - protein, 282 aa, Homo sapiens [sequence omitted]

SEQ ID NO: 493 - protein, 224 aa, Homo sapiens [sequence omitted]

SEQ ID NO: 494 - protein, 261 aa, Homo sapiens
MADDAGAAGGHGGPGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 495 - protein, 126 aa, Homo sapiens [sequence omitted]

SEQ ID NO: 496 - protein, 312 aa, Homo sapiens [sequence omitted]

SEQ ID NO: 497 - protein, 462 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQA

SEQ ID NO: 498 - protein, 546 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 499 - protein, 546 aa, Homo sapiens; identical to SEQ ID NO: 498

SEQ ID NO: 500 - protein, 132 aa, Homo sapiens
MCELMKQQETHLKQQLALYTEKFEEFQNTLSKSSEVFTTFKQEMEKVTVVQARHGCWGISCFIQNCWACLQEAPIWGVSRAGLLGRFTAFPLLRQYQWYVYTPGCPREWGSLFCLFGFFGGFVVVVVVVVVV

SEQ ID NO: 501 - protein, 455 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 502 - protein, 455 aa, Homo sapiens; identical to SEQ ID NO: 501

SEQ ID NO: 503 - protein, 455 aa, Homo sapiens; identical to SEQ ID NO: 501

SEQ ID NO: 504 - protein, 455 aa, Homo sapiens; identical to SEQ ID NO: 501

SEQ ID NO: 505 - protein, 773 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 506 - protein, 773 aa, Homo sapiens; identical to SEQ ID NO: 505

SEQ ID NO: 507 - protein, 96 aa, Homo sapiens
FWQTSNDTEPPLPISPLSFTKLIHFELAPAIYSELTSEQKIEVATAPYVDVNCDSRRTVEKCLDPGRKGYRENMSLTTLEATYAKSIKHTIKSMWE

SEQ ID NO: 508 - protein, 46 aa, Homo sapiens
FWQTSNDTEPPLPISPLSFTKLIHFELAPAIYSELTSEQKIEVGSC

SEQ ID NO: 509 - protein, 137 aa, Homo sapiens
DDFVTGQRKPGWKCSLICKYSLIRISSPSYFPSPTLPQAKILFPGALSSAGSFLSLSPSLHLCCAKSGHDCRVVHGFQRELHKYTSFRGRGRTWRSQESKTMPVSFSDDKGYCWMKVCILLWCGKDLILSALWMCPV

SEQ ID NO: 510 - protein, 107 aa, Homo sapiens
NNSECYNSSHLRLDINLSQILWNIDGKNSGTRRRYEKGFTRFMEKLRTVCRLGNTGPDSVPRSPCPSILLIAQVNILPCLGLPRTNMALDAFGWLGLAAYFSLKLKF

SEQ ID NO: 511 - protein, 55 aa, Homo sapiens
CLLLRWRILEEEKFEGREMPILIQPSLMFEIHVRKVKQHTSSAVMKIKAIDSKCN

SEQ ID NO: 512 - protein, 58 aa, Homo sapiens [sequence omitted]

SEQ ID NO: 513 - protein, 47 aa, Homo sapiens [sequence omitted]

SEQ ID NO: 514 - protein, 312 aa, Homo sapiens
MSSSSSSHPFLLTGFPGLEEAHHWISVFFLFMYISILFGNGTLLLLIKEDHNLHEPMYFFLAMLAATDLGLALTTMPTVLGVLWLDHREIGSAACFSQAYFIHSLSFLESGILLAMAYDRFIAICNPLRYTSVLTNTRVVKIGLGVLMRGFVSVVPPIRPLYFFLYCHSHVLSHAFCLHQDVIKLACADTTFNRLYPAVLVVFIFVLDYLIIFISYVLILKTVLSIASREERAKALITCVSHICCVLVFYVTVIGLSLIHRFGKQVPHIVHLIMSYAYFLFPPLMNPITYSVKTKQIQNAILHLFTTHRIGT

SEQ ID NO: 515 - protein, 111 aa, Homo sapiens
RYASCNEEKPCFSSWITDCNIHQHQDKHLQTTVLGVQPNRSEECDKGTLDSQGLLRFPSITRSSQIQLNRPAETTDFFRLSSEVRNLLNGLNNNNKQYRKSASSTQQPKSG

SEQ ID NO: 516 - protein, 50 aa, Homo sapiens
MSFPSISENYLDNFFLSQFSESAVFCQETFIDDDGNSRLKSDEVLFLKKG

SEQ ID NO: 517 - protein, 50 aa, Homo sapiens; identical to SEQ ID NO: 516

SEQ ID NO: 518 - protein, 50 aa, Homo sapiens; identical to SEQ ID NO: 516

SEQ ID NO: 519 - protein, 414 aa, Homo sapiens [sequence omitted]

SEQ ID NO: 520 - protein, 189 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWKTKYHPPPEKCRIKIFH

SEQ ID NO: 521 - protein, 363 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVETMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMVSDCLVEGGHF

SEQ ID NO: 522 - protein, 36 aa, Homo sapiens
MAALRYAGLDDTDSEDELPPGWEERTTKDGWVYYAK

SEQ ID NO: 523 - DNA, 201 bp, Homo sapiens
catggtttcagataaggggaatttgatgtactcagacaacaggtcctttcaggggaaagagagcatttttggagacaacatgaacgaactccaaacatttstggccaaccggcagaaggataacctcaataactatgtattccagggacaacatcctcttactctcaatgagtccaaccctaacacggtggaggtggccgt

SEQ ID NO: 524 - DNA, 201 bp, Homo sapiens
aagaccacagtggacaacagctttgtgggctgggacatgcagaatgtgatcacactggacacttcctttgaggatgcaaagacacaagtccagctgaagargatccactcttctgtcatcttgctctactgttccaaagacgaggctgttctcattctgagtgaggcccgctcccttggcctcaccgggtatgatttcttc

SEQ ID NO: 525 - DNA, 201 bp, Homo sapiens
tgaccggcctcagtgacaaaaagtttcagagacctcatgactattccccaccttttcgatttgggacagtgcctaatggaagcacggagagaaacattcgsaataactatccctacatgcatcagtacatgaccaaatttaatcagaaaggagtagaggacgccttggtcagcctgaaaacggggaagctggacgctttca

SEQ ID NO: 526 - DNA, 201 bp, Homo sapiens
tgagcagccagctggacattgacaacatggcgggcgtattctacatgctggctgccgccatggcccttagcctcatcaccttcatctgggagcacctcttytactggaagctgcgcttctgtttcacgggcgtgtgctccgaccggcctgggttgctcttctccatcagcaggggcatctacagctgcattcatggagtgc

SEQ ID NO: 527 - DNA, 201 bp, Homo sapiens
gacttatccttcactgaggaaggctaccaggtgcaccccaggctggtggtgattgtgctgaacaaagaccgggaatgggaaaaggtgggcaagtgggagamccatacgctgagcctgaggcacgccgtgtggcccaggtacaagtccttctccgactgtgagccggatgacaaccatctcagcatcgtcaccctggaggag

SEQ ID NO: 528 - DNA, 201 bp, Homo sapiens
ggtacaagtccttctccgactgtgagccggatgacaaccatctcagcatcgtcaccctggaggaggccccattcgtcatcgtggaagacatagaccccctraccgagacgtgtgtgaggaacaccgtgccatgtcggaagttcgtcaaaatcaacaattcaaccaatgaggggatgaatgtgaagaaatgctgcaaggggt

SEQ ID NO: 529 - DNA, 201 bp, Homo sapiens
gcctaatggtttctctaatacagaataagcaatatggtgtgcatgtaaacctgacacagacaaaataaaaacagttaagaatgcatctgcactgtagtgcrattgacatgtgcaagagattaggaagtttggctcgtaacagtttcagctttcttgttatgccttccatcacagcccaggctcaccccaagaactccaggc

SEQ ID NO: 530 - DNA, 201 bp, Homo sapiens
ggtgtgcatgtaaacctgacacagacaaaataaaaacagttaagaatgcatctgcactgtagtgcgattgacatgtgcaagagattaggaagtttggctcrtaacagtttcagctttcttgttatgccttccatcacagcccaggctcaccccaagaactccaggctcccctaaagaatagcaaatcagtgtgttcgtgat

SEQ ID NO: 531 - DNA, 201 bp, Homo sapiens
gtttatcttccttcacatccagaaattctgttggacactcacttccaccccaaactcctcaaatcaaaagccttcaaaacacgaggcactcttggatctaycctgagtatcctccaaactgtggatacagtttagtgagacaagcaatttctcccttctgagttattctctctgttggtggcaaaccacttcatagcacca

SEQ ID NO: 532 - DNA, 201 bp, Homo sapiens
gccgccagcctgggctccgcgcagcccaccgatctgggcgcccacaagcggccggcatccgtgtcgagcagcgctgccgtggagcacgagcagcgtgaggyggcagccaaggagaaacaaccgccgccgcctgcgcaccggggcccggccgacagcctgtccaccgcggccggggccgccgagctgagcgcggaaggtgcg

SEQ ID NO: 533 - DNA, 201 bp, Homo sapiens
gaacagcaaggaaaaggaagccctctccagaaccagaaggtgaagtcgggccccctaagatcaacggagaggcccagccgtggctgtccacatccacagargggctcaagatccccatgactcctacatcctcttttgtgtctccgccaccacccactgcctcacctcattccaaccggaccacaccgcctgaagcggccc

SEQ ID NO: 534 - DNA, 201 bp, Homo sapiens
cgggcaagagccgcgggtctggagagcaggactgggtcaacaggcccaagaccgtgcgcgacacgctgctggcgctgcaccagcacggccactcggggccyttcgagagcaagtttaagaaggagccggccctgactgcaggcaggttgttgggtttcgaggccaacggggccaacgggtctaaagcagttgcaagaacag

SEQ ID NO: 535 - DNA, 201 bp, Homo sapiens
gggcgccgaccgcgtcgagttcgtcatcgagacggcgcggcagctcaagcgggcgcacggctgcttcccggagggtcgctccccacccggcgccgcggccycggccgccgccaagccgccgccgctctccgccaaggacatccttttgcagcagcagcagcagcttggccacggcggccccgaggcggccccgcgcgcgcc

SEQ ID NO: 536 - DNA, 201 bp, Homo sapiens
gcagtcatgcctcaaaagatgccaaccaggttcactccactaccaggaggaatagcaacagtccgccctctccgtcctctatgaaccaaagaaggctgggycccagagaggtggggggccagggagcaggcaacacaggaggactggagccagtgcaccctgccagcctcccggactcctctctggcaaccagtgccccgc

SEQ ID NO: 537 - DNA, 201 bp, Homo sapiens
ctgggtcaacaggcccaagaccgtgcgcgacacgctgctggcgctgcaccagcacggccactcggggcccttcgagagcaagtttaagaaggagccggccytgactgcaggcaggttgttgggtttcgaggccaacggggccaacgggtctaaagcagttgcaagaacagcaaggaaaaggaagccctctccagaaccaga

SEQ ID NO: 538 - DNA, 201 bp, Homo sapiens
aggccaacggggccaacgggtctaaagcagttgcaagaacagcaaggaaaaggaagccctctccagaaccagaaggtgaagtcgggccccctaagatcaayggagaggcccagccgtggctgtccacatccacagaggggctcaagatccccatgactcctacatcctcttttgtgtctccgccaccacccactgcctcac

SEQ ID NO: 539 - DNA, 201 bp, Homo sapiens
gcagcgctgccgtggagcacgagcagcgtgaggcggcagccaaggagaaacaaccgccgccgcctgcgcaccggggcccggccgacagcctgtccaccgckgccggggccgccgagctgagcgcggaaggtgcgggcaagagccgcgggtctggagagcaggactgggtcaacaggcccaagaccgtgcgcgacacgctgc

SEQ ID NO: 540 - DNA, 201 bp, Homo sapiens
ccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataa

SEQ ID NO: 541 - DNA, 201 bp, Homo sapiens
cttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaa

SEQ ID NO: 542 - DNA, 201 bp, Homo sapiens
ttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaat

SEQ ID NO: 543 - DNA, 201 bp, Homo sapiens
tcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatc

SEQ ID NO: 544 - DNA, 201 bp, Homo sapiens
agaattcatgttttaccagtcattgttatattacaaacagacttgcatgattaaccagttgttacacttactttttcaagttggagtatatatgactcagkgcagactggtctctcttatgtgaatgcacacatgcagaaatgcagagtcaattttacatgcccataaagacatttgtaaagaattcagctcttatggtct

SEQ ID NO: 545 - DNA, 201 bp, Homo sapiens
atttgtaaagaattcagctcttatggtctgttgtataaatgtgtatctaggcactttattataggaatttgacctcacagatgttacaacttgatcagtcrtttgacctaatttgtggtagctatctgtatgttttgcaatcttaatacagacatgctttccaaaaagattaatacagaaccatcctgccgttttggataa

SEQ ID NO: 546 - DNA, 201 bp, Homo sapiens
tgactggcctttgggtggcctttgtggacggctcgtagctggaaagtgttgatctgggttttctggcattcttttaagttaaaaagttaacatcgggacakgggtttgatcttttgttgtacctgatgacagtgcagagattctccacagctggataaaaatgtcacaaagctacttactgtacatgggcagtatcagatt

SEQ ID NO: 547 - DNA, 201 bp, Homo sapiens
gtgtgccaccttttaacctttactttttttaagttgaaggtgatactttttctatatatgatgaaactcatgtcaactgaagtgagtgtaatctcagataycaacattattatattttaaaatcacgctatggaaatatcacctgaattctgtcatttgtcagatttacagtacctttttttctttaacttttagcattaa

SEQ ID NO: 548 - DNA, 201 bp, Homo sapiens
tggatcacctgcgacagctgcagaacatcattcaggccacgtccagggagatcatgtggatcaatgactgcgaggaggaggagctgctgtacgactggagsgacaagaacaccaacatcgctcagaaacaggaggccttctccatacgcatgagtcaactggaagttaaagaaaaagagctcaataagctgaaacaagaaa

SEQ ID NO: 549 - DNA, 201 bp, Homo sapiens
tggagcagcacattaacagccaccggggcatccacaactccatcggcgactatcgctggcagctggacaaaatcaaagccgacctgcgcgagaaatctgckatctaccagttggaggaggagtatgaaaacctgctgaaagcgtcctttgagaggatggatcacctgcgacagctgcagaacatcattcaggccacgtcca

SEQ ID NO: 550 - DNA, 201 bp, Homo sapiens
gtgttcccagttcaaagcgaagcttgcgagcctggaggagctgaagagacaggctgagctggatgggaagtcggctaagcaaaatctagacaagtgctacsgccaaataaaagaactcaatgagaagatcacccgactgacttatgagattgaagatgaaaagagaagaagaaaatctgtggaagacagatttgaccaaca

SEQ ID NO: 551 - DNA, 201 bp, Homo sapiens
aaacaaatgaccggaaatgcctggaagatgaaaacgcgagattacaaagggtccagtatgacctgcagaaagcaaacagtagtgcgacggagacaataaamaaactgaaggttcaggagcaagaactgacacgcctgaggatcgactatgaaagggtttcccaggagaggactgtgaaggaccaggatatcacgcggttcc

SEQ ID NO: 552 - DNA, 201 bp, Homo sapiens
ggagattgataaactcagacagcgcccatatgggtcccatcgagagacccagactgagtgtgagtggaccgttgacacctccaagctggtgtttgatgggytgaggaagaaggtgacagcaatgcagctctatgagtgtcagctgatcgacaaaacaaccttggacaaactattgaaggggaagaagtcagtggaagaagt

SEQ ID NO: 553 - DNA, 201 bp, Homo sapiens
ccattacagaaggtatagagcggggcatcgttgacagcatcacgggtcagaggcttctggaggctcaggcctgcacaggtggcatcatccacccaaccacrggccagaagctgtcacttcaggacgcagtctcccagggtgtgattgaccaagacatggccaccaggctgaagcctgctcagaaagccttcataggcttcg

SEQ ID NO: 554 - DNA, 201 bp, Homo sapiens
ccagcaccagacagtgaccacaactgaaatcactcatcatggaacctgccaagatgtcaaccataataaagtaattgaaaccaacagagaaaatgacaagyaagaaacatggatgctgatggagctgcagaagattcgcaggcagatagagcactgcgagggcaggatgactctcaaaaacctccctctagcagaccaggg

SEQ ID NO: 555 - DNA, 201 bp, Homo sapiens
agtatgaaaacctgctgaaagcgtcctttgagaggatggatcacctgcgacagctgcagaacatcattcaggccacgtccagggagatcatgtggatcaakgactgcgaggaggaggagctgctgtacgactggagcgacaagaacaccaacatcgctcagaaacaggaggccttctccatacgcatgagtcaactggaag

SEQ ID NO: 556 - DNA, 201 bp, Homo sapiens
ctggagcgacaagaacaccaacatcgctcagaaacaggaggccttctccatacgcatgagtcaactggaagttaaagaaaaagagctcaataagctgaaayaagaaagtgaccaacttgtcctcaatcagcatccagcttcagacaaaattgaggcctatatggacactctgcagacgcagtggagttggattcttcagat

SEQ ID NO: 557 - DNA, 201 bp, Homo sapiens
agcagtatccactttatgatctggacttgggcaagttcggtgaaaaagtcacacagctgacagaccgctggcaaaggatagataaacagatcgactttagrttatgggacctggagaaacaaatcaagcaattgaggaattatcgtgataactatcaggctttctgcaagtggctctatgatgctaaacgccgccaggatt

SEQ ID NO: 558 - DNA, 201 bp, Homo sapiens
aggctgcagtctctcacagagaacctgaccaaggagcacttgatgttagaagaagaactgcggaacctgaggctggagtacgatgacctgaggagaggacraagcgaagcggacagtgataaaaatgcaaccatcttggaactaaggagccagctgcagatcagcaacaaccggaccctggaactgcaggggctgattaat

SEQ ID NO: 559 - DNA, 201 bp, Homo sapiens
gctgcagaacatcattcaggccacgtccagggagatcatgtggatcaatgactgcgaggaggaggagctgctgtacgactggagcgacaagaacaccaacwtcgctcagaaacaggaggccttctccatacgcatgagtcaactggaagttaaagaaaaagagctcaataagctgaaacaagaaagtgaccaacttgtcct

SEQ ID NO: 560 - DNA, 201 bp, Homo sapiens
agaaagccttcataggcttcgagggtgtgaagggaaagaagaagatgtcagcagcagaggcagtgaaagaaaaatggctcccgtatgaggctggccagcgmttcctggagttccagtacctcacgggaggtcttgttgacccggaagtgcatgggaggataagcaccgaagaagccatccggaaggggttcatagatggcc

SEQ ID NO: 561 - DNA, 201 bp, Homo sapiens
aaaaacaaggagatagaaaggttaaaacaactgatcgacaaagaaacaaatgaccggaaatgcctggaagatgaaaacgcgagattacaaagggtccagtrtgacctgcagaaagcaaacagtagtgcgacggagacaataaacaaactgaaggttcaggagcaagaactgacacgcctgaggatcgactatgaaagggtt

SEQ ID NO: 562 - DNA, 201 bp, Homo sapiens
tcaatcagcatccagcttcagacaaaattgaggcctatatggacactctgcagacgcagtggagttggattcttcagatcaccaagtgcattgatgttcayctgaaagaaaatgctgcctactttcagttttttgaagaggcgcagtctactgaagcatacctgaaggggctccaggactccatcaggaagaagtacccct

SEQ ID NO: 563 - DNA, 201 bp, Homo sapiens
cgcggatcaacactctgggccgcatgatccgcgccgagtctggcccggacctgcgctacgaggtgaccagcggcggcgggggcaccagcaggatgtactaytctcggcgcggcgtgatcaccgaccagaactcggacggctactgtcaaaccggcacgatgtccaggcaccagaaccagaacaccatccaggagctgctgc

SEQ ID NO: 564 - DNA, 201 bp, Homo sapiens
ctattctccaaacagaagacatgttaaaggtttatgaagccaggctcactgaggaggaaactgtctgcctggacctggataaagtggaagcttaccgctgwggactgaagaaaataaaaaatgacttgaacttgaagaagtcgttgttggccactatgaagacagaactacagaaagcccagcagatccactctcagactt

SEQ ID NO: 565 - DNA, 201 bp, Homo sapiens
aagaaacatggatgctgatggagctgcagaagattcgcaggcagatagagcactgcgagggcaggatgactctcaaaaacctccctctagcagaccagggrtcttctcaccacatcacagtgaaaattaacgagcttaagagtgtgcagaatgattcacaagcaattgctgaggttctcaaccagcttaaagatatgcttg

SEQ ID NO: 566 - DNA, 201 bp, Homo sapiens
acacagtcatgcggtttttgaatgagcagaagaacttgcacagtgaaatatctggcaaacgagacaaatcagaggaagtacaaaaaattgctgaactttgygccaattcaattaaggattatgagctccagctggcctcatacacctcaggactggaaactctgctgaacatacctatcaagaggaccatgattcagtccc

SEQ ID NO: 567 - DNA, 201 bp, Homo sapiens
gctccatggtagaagatatcactgggctgcgccttctggaagccgcctccgtgtcgtccaagggcttacccagcccttacaacatgtcttcggctccgggstcccgctccggctcccgctcgggatctcgctccggatctcgctccgggtcccgcagtgggtcccggagaggaagctttgacgccacagggaattcttcct

SEQ ID NO: 568 - DNA, 201 bp, Homo sapiens
agcagcatctggagatagaactgaagcaggtcatgcagcagcgctctgaggacaatgcccggcacaagcagtccctggaggaggctgccaagaccattcargacaaaaataaggagatcgagagactcaaagctgagtttcaggaggaggccaagcgccgctgggaatatgaaaatgaactgagtaaggtaagaaacaatt

SEQ ID NO: 569 - DNA, 201 bp, Homo sapiens
atcagtaccgatccggcagcctcagcctcactcaatttgctgacatgatctccttgaaaaatggtgtcggcaccagcagcagcatgggcagtggtgtcagygatgatgtttttagcagctcccgacatgaatcagtaagtaagatttccaccatatccagcgtcaggaatttaaccataaggagcagctctttttcagaca

SEQ ID NO: 570 - DNA, 201 bp, Homo sapiens
atcctgaaacaggaaacatcatctctttgttccaagccatgaataaggaactcatcgaaaagggccacggtattcgcttattagaagcacagatcgcaacyggggggatcattgacccaaaggagagccatcgtttaccagttgacatagcatataagaggggctatttcaatgaggaactcagtgagattctctcagatc

SEQ ID NO: 571 - DNA, 201 bp, Homo sapiens
acctgcagaaataccaggcagagtgttcccagttcaaagcgaagcttgcgagcctggaggagctgaagagacaggctgagctggatgggaagtcggctaakcaaaatctagacaagtgctacggccaaataaaagaactcaatgagaagatcacccgactgacttatgagattgaagatgaaaagagaagaagaaaatctg

SEQ ID NO: 572 - DNA, 201 bp, Homo sapiens
atcagggccatgacaatcgccaagctgaaaacaatgcggcaggaagattacatgaagacgatagccgaccttgagttacattaccaagagttcatcagaartagccaaggctcagagatgtttggagatgatgacaagcggaaaatacagtctcagttcaccgatgcccagaagcattaccagaccctggtcattcagctc

SEQ ID NO: 573 - DNA, 201 bp, Homo sapiens
ggaggtcttgttgacccggaagtgcatgggaggataagcaccgaagaagccatccggaaggggttcatagatggccgcgccgcacagaggctgcaagacamcagcagctatgccaaaatcctgacctgccccaaaaccaaattaaaaatatcctataaggatgccataaatcgctccatggtagaagatatcactgggctg

SEQ ID NO: 574 - DNA, 201 bp, Homo sapiens
tcagagctctctgtgactacaaacaagatcagaaaatcgtgcataagggggatgagtgtatcctgaaggacaacaacgagcgcagcaagtggtacgtgacrggcccgggaggcgttgacatgcttgttccctctgtggggctgatcatccctcctccgaacccactggccgtggacctctcttgcaagattgagcagtact

SEQ ID NO: 575 - DNA, 201 bp, Homo sapiens
atgatccattttcaggcaagacagtatctgtttcagaagccatcaagaaaaatttgattgatagagaaaccggaatgcgcctgctggaagcccagattgcytcagggggtgtagtagaccctgtgaacagtgtctttttgccaaaagatgtcgccttggcccgggggctgattgatagagatttgtatcgatccctgaatg

SEQ ID NO: 576 - DNA, 201 bp, Homo sapiens
agaacgagctgtcactgggtataatgatcctgaaacaggaaacatcatctctttgttccaagccatgaataaggaactcatcgaaaagggccacggtattygcttattagaagcacagatcgcaaccggggggatcattgacccaaaggagagccatcgtttaccagttgacatagcatataagaggggctatttcaatga

SEQ ID NO: 577 - DNA, 201 bp, Homo sapiens
gacagtgataaaaatgcaaccatcttggaactaaggagccagctgcagatcagcaacaaccggaccctggaactgcaggggctgattaatgatttacagakagagagggaaaatttgagacaggaaattgagaaattccaaaagcaggctttagaggcatctaataggattcaggaatcaaagaatcagtgtactcaggtg

SEQ ID NO: 578 - DNA, 201 bp, Homo sapiens
tcctgaaacaggaaacatcatctctttgttccaagccatgaataaggaactcatcgaaaagggccacggtattcgcttattagaagcacagatcgcaaccsgggggatcattgacccaaaggagagccatcgtttaccagttgacatagcatataagaggggctatttcaatgaggaactcagtgagattctctcagatcc

SEQ ID NO: 579 - DNA, 201 bp, Homo sapiens
gtgataggacattctatgcttacagaaaatatagccatgattgaaatcaaatagtaaaggctgttctggctttttatcttcttagctcatcttaaataagyagtacacttggatgcagtgcgtctgaagtgctaatcagttgtaacaatagcacaaatcgaacttaggatttgtttcttctcttctgtgtttcgatttttg

SEQ ID NO: 580 - DNA, 201 bp, Homo sapiens
tttgtttcttctcttctgtgtttcgatttttgatcaattctttaattttggaagcctataatacagttttctattcttggagataaaaattaaatggatcmctgatattttagtcattctgcttctcatctaaatatttccatattctgtattaggagaaaattaccctcccagcaccagcccccctctcaaacccccaac

SEQ ID NO: 581 - DNA, 201 bp, Homo sapiens
tttgtgatctaactcaagctgatcgtcttgccctctatgatttcgtagttgaggagacaaagaaaaagcgctctgattctcaaattattgaaaatgacagygatctctttgtagacttggctgccaaaatcaatcaagacaatagtcgaaaaagtccaaaatcctaccttgaaatcctggcagaagtacgagattataaaa

SEQ ID NO: 582 - DNA, 201 bp, Homo sapiens
agcggcggcggctgcaggaggagctgaacgagttcgtggagagcggctgccggacgttggaggaggtgaccgcgtccctgggctgggacctagatagtctrgatcccggggaagaggaggcggcggaggatgaagttgtgatatgtccatacgattccaatcatcacatgcctaaatcatctttggcaaagcacatggcat

SEQ ID NO: 583 - DNA, 201 bp, Homo sapiens
ggacgttggaggaggtgaccgcgtccctgggctgggacctagatagtctggatcccggggaagaggaggcggcggaggatgaagttgtgatatgtccataygattccaatcatcacatgcctaaatcatctttggcaaagcacatggcatcttgtagattgaggaaaatgggctataccaaagaagaagaggatgaaatgt

SEQ ID NO: 584 - DNA, 201 bp, Homo sapiens
atttcgtagttgaggagacaaagaaaaagcgctctgattctcaaattattgaaaatgacagcgatctctttgtagacttggctgccaaaatcaatcaagayaatagtcgaaaaagtccaaaatcctaccttgaaatcctggcagaagtacgagattataaaagaagacgccagtcctatagagccaagaatgttcacataa

SEQ ID NO: 585 - DNA, 201 bp, Homo sapiens
cggcggctgcaggaggagctgaacgagttcgtggagagcggctgccggacgttggaggaggtgaccgcgtccctgggctgggacctagatagtctggatcycggggaagaggaggcggcggaggatgaagttgtgatatgtccatacgattccaatcatcacatgcctaaatcatctttggcaaagcacatggcatcttgt

SEQ ID NO: 586 - DNA, 201 bp, Homo sapiens
cacatggaagaactcagcaatcattggcaagaagagcaagagaaggcagaggatgatgccgaaaagaatgaagaaaggcgatcagcttcagtagattcacrgcagtctggtggaagctatttggatgctgagtgttcacgacatagaagggataggagtagaagcccacataaaagaaaaagaaacaaagataaggataaa

SEQ ID NO: 587 - DNA, 201 bp, Homo sapiens
gataaggataaaaactgtgagtcgagaagaaggaaagagagggatggggaaagacaccatagtcataaaagaagaaagcaaaaaatataaatgaagtactygtacctatattaattatgcttacgccatgataaccaatatacagatatattaattggaattcctttgcataggagaatgtttttatgatctgtttagtgc

SEQ ID NO: 588 - DNA, 201 bp, Homo sapiens
gagaagaaggaaagagagggatggggaaagacaccatagtcataaaagaagaaagcaaaaaatataaatgaagtacttgtacctatattaattatgcttaygccatgataaccaatatacagatatattaattggaattcctttgcataggagaatgtttttatgatctgtttagtgcttattattttttttatgatctgt

SEQ ID NO: 589 - DNA, 201 bp, Homo sapiens
taaattaaacatgaatacattctcatcttataactacatcttataaataaggctaataacccttagaacaccacctgcggttctgtcctcaccccagtggygactactgtttaccactacactggtgaattgtagtagggaaaaacaatctaaatattgaagaggaatggcctaattaaaatatgatgtagtcataggata

SEQ ID NO: 590 - DNA, 201 bp, Homo sapiens
gtcttaatgtttcatttaatttaaaatatactgtcatgttgtgttttgtaaatcaactgaattgaggtactatttacttagatttattgcaccctttttamgtgtgtattttattgggttttgacagattcatacctctgtgcagccactatcacgatcaagatacaaatattttcattgcccccaaaattctcatacccc

SEQ ID NO: 591 - DNA, 201 bp, Homo sapiens
ccgacatctaaatagcaatattttgaatactggaaactcaggttaaagattttgtttccaagtagaaatgaaatcttattattttaataagtagctgacartgacagaaagattggatttggatcagattggctgttaggcttcaggtatgggaaacagctctcagatttataaattggaaatcaccaggttacttgccaa

SEQ ID NO: 592 - DNA, 201 bp, Homo sapiens
ttgaatcatcaggaatttcatatttttcatattgtgtgacaacttataattttgtttcaaattgtgatttcattgattttactaactggaaggaagaagartaaaattggcatatttaggttttttgtagaagaaagatacaagtgaaaattaggagtggattggagaaattggggggaaatagaagagtacggagaaagg

SEQ ID NO: 593 - DNA, 201 bp, Homo sapiens
cactgctacaaactatttaatgaaatgtggcatcgggtgaaaagaggcatttgtttgatccttgaacgaattaatctcacgtacttccctgtttgtggttkgagcctttcactggatgtgagctacttgagagcagggtttatgccttcatcagcgtgacccctgtgcctgcagcctcataggtgttaatctgtaatttta

SEQ ID NO: 594 - DNA, 201 bp, Homo sapiens
tgctgtccatcttgcccatccattaaggtaccttctcacaaacatttctaatctactggctggagtgcagtggtgcagtctgtagctcactgcagcctcaractcctaggctcaggcgatcctcttgccctggcctcccatgtagctgcaactataggtgtgtgccactacacctggctaatgtttttagttttttagaga

SEQ ID NO: 595 - DNA, 158 bp, Homo sapiens
tctataaacatgttcataggtcttccccctcgccccgcccgtcttctaagggcattttctgtttctttttagtgagttcatgaatgtttaacggttctggygcaaagctttcttgcattctgagcataaaaataataaaacccacttatatttgcttg

SEQ ID NO: 596 - DNA, 201 bp, Homo sapiens; identical to SEQ ID NO: 582

SEQ ID NO: 597 - DNA, 201 bp, Homo sapiens; identical to SEQ ID NO: 583

SEQ ID NO: 598 - DNA, 201 bp, Homo sapiens; identical to SEQ ID NO: 585

SEQ ID NO: 599 - DNA, 201 bp, Homo sapiens
acatattatagtcttgaattggaattttggttgaattacaaggaatttaagtatcagtcttcatcataaagaaatttaagatgaataaattgaagaaaagkctaaaataatttaagaaggaaattatatttctttgtttaaaaataacaggcaaaggtttatatgaagcttgtttgtaatacatcattattttctaatctg

SEQ ID NO: 600 - DNA, 201 bp, Homo sapiens
attagaataaaattgattgacttgaaagggaacccttttttccccattaattcaaaaccctttgacgagtaaaaatggccatatattgttatgtatagccrtgttaaaccatggcctcagattcactgcagctctcctcttaatatgtagacaagtagtacctcttttttgttgtaatgcttagttcatagtatgctctta

SEQ ID NO: 601 - DNA, 201 bp, Homo sapiens
cccattaattcaaaaccctttgacgagtaaaaatggccatatattgttatgtatagccgtgttaaaccatggcctcagattcactgcagctctcctcttartatgtagacaagtagtacctcttttttgttgtaatgcttagttcatagtatgctcttatttgaattctttttgcctctacctaggaacttaatgaggtta

SEQ ID NO: 602 - DNA, 201 bp, Homo sapiens
tggagagaatagcaaacatccataatacatttttttttttttgtggatataacattcaggatagaattgtttgtcatttattgcttagattgatattttgyatacttagggattatgaaaaaagtttgtgttaatattgcattattaaagcacatgtttaaagataattattagattttaagttcacaatgcttcatgtat

SEQ ID NO: 603 - DNA, 201 bp, Homo sapiens; identical to SEQ ID NO: 581

SEQ ID NO: 604 - DNA, 201 bp, Homo sapiens; identical to SEQ ID NO: 584

SEQ ID NO: 605 - DNA, 201 bp, Homo sapiens; identical to SEQ ID NO: 586

SEQ ID NO: 606 - DNA, 201 bp, Homo sapiens; identical to SEQ ID NO: 587

SEQ ID NO: 607 - DNA, 201 bp, Homo sapiens; identical to SEQ ID NO: 588

SEQ ID NO: 608 - DNA, 201 bp, Homo sapiens; identical to SEQ ID NO: 589

SEQ ID NO: 609 - DNA, 201 bp, Homo sapiens; identical to SEQ ID NO: 590

SEQ ID NO: 610 - DNA, 201 bp, Homo sapiens; identical to SEQ ID NO: 591

SEQ ID NO: 611 - DNA, 201 bp, Homo sapiens; identical to SEQ ID NO: 592

SEQ ID NO: 612 - DNA, 201 bp, Homo sapiens; identical to SEQ ID NO: 593

SEQ ID NO: 613 - DNA, 201 bp, Homo sapiens; identical to SEQ ID NO: 594

SEQ ID NO: 614 - DNA, 158 bp, Homo sapiens; identical to SEQ ID NO: 595

SEQ ID NO: 615 - DNA, 201 bp, Homo sapiens; identical to SEQ ID NO: 581

SEQ ID NO: 616 - DNA, 201 bp, Homo sapiens; identical to SEQ ID NO: 582

SEQ ID NO: 617 - DNA, 201 bp, Homo sapiens; identical to SEQ ID NO: 583

SEQ ID NO: 618 - DNA, 201 bp, Homo sapiens; identical to SEQ ID NO: 584

SEQ ID NO: 619 - DNA, 201 bp, Homo sapiens; identical to SEQ ID NO: 585

SEQ ID NO: 620 - DNA, 201 bp, Homo sapiens; identical to SEQ ID NO: 586

SEQ ID NO: 621 - DNA, 201 bp, Homo sapiens
gaaagagagccaggtgtggtggttcgcgcctgaaatccagctgcttgggaggctgaggcaggaatcgcttgaatccgggaggcgaaggttgcagtgagccragatcgtgccatttgcgctccagcctgggcaacaagagtgaaactccatctcaaaaaaacagaaacaaacaaataaaaaaactaagagacgaaactgaaa

SEQ ID NO: 622 - DNA, 201 bp, Homo sapiens
gggcaacaagagtgaaactccatctcaaaaaaacagaaacaaacaaataaaaaaactaagagacgaaactgaaataggaataatcaaagtgattttttttwaattacgctttgaaattctgctttaaaattaactttgagtatatgtaaatgataaccagaaaattcttttcaaatagaatgttaaagtagcatattactg

SEQ ID NO: 623 - DNA, 201 bp, Homo sapiens
cagcccggggagaaagaggaggaggacgacaatgaagaggaaggggacaggaaaacgggcaagcaggcttttatgggagagcaagagaagttggatgtacrtgagaaatctaaggcagataagatgaaagaagggtcagattcttctgtatcctcagaaaaaggaggccggcttcctactcccaagctgagagaacttggt

SEQ ID NO: 624 - DNA, 201 bp, Homo sapiens
tcggagtagcgggggctccggcgccgggcgacatgccggtgcgcttcaaggggctgagtgaataccagaggaacttcctgtggaaaaagtcttatttgtcmgagtcttgtaattcctccgtggggcgaaagtacccatgggctggacttagatcagatcaattaggcatcacgaaagagccaagttttatttcaaaaagaa

SEQ ID NO: 625 - DNA, 201 bp, Homo sapiens
gagtggaatggagctatctcagagagcaatgtggttgcatcaccagaaccagaagccccggaaacaccaaaatcacaagaagcagaacaaaaggatgttaytcaagaaagagttcactcactagaagcttccagggttcccaaaagaaccagatctcactctgcagactccagagctgaaggggcttcagatgtggaaaat

SEQ ID NO: 626 - DNA, 201 bp, Homo sapiens
agaatgattttactaagaaagaaagtcgtgctgtatccctactgacttctccagctgctggtataaaaacagttgatcctctgcctttgcgggaagattckgaagacaatatccacaaatttgctgaggcaactcttccagtttcaaaaattccaaaatacccaacaaatccccctggacagttgccttctccaccacatg

SEQ ID NO: 627 - DNA, 201 bp, Homo sapiens
agttcaggggacgcatttttctcgggaccatctgaatcagattttatctgatagcaactgctgttgggatgtctcctcaaccacaagctcagaaggaaccrttagtagcaacatcagagcattagatcttgctggagatcctacaagccataagactttgcagaaatgtccttctacagaaccagaagaaaaaggaaatat

SEQ ID NO: 628 - DNA, 201 bp, Homo sapiens
agagaacttggtggaatccagaggactcatcatgatctcactactccagctgttggtggtgctgttttagtgtctccatctaagatgaagcctccagcccyagaacagaggaaaagaatgacctctcaggattgtttagaaacttcaaagaatgattttactaagaaagaaagtcgtgctgtatccctactgacttctcca

SEQ ID NO: 629 - DNA, 201 bp, Homo sapiens
ataccacggagaaattgggtgtgtcagctcccaccatacccgttagaaggcggctggcttgggatacagagaacacaagtgaagacgtacagaaacagccyggggagaaagaggaggaggacgacaatgaagaggaaggggacaggaaaacgggcaagcaggcttttatgggagagcaagagaagttggatgtacatgaga

SEQ ID NO: 630 - DNA, 201 bp, Homo sapiens
tttgcgggaagattctgaagacaatatccacaaatttgctgaggcaactcttccagtttcaaaaattccaaaatacccaacaaatccccctggacagttgycttctccaccacatgttccatcctactggcatccctctcgacgaattcagggctctcttagagatccagagtttcagcacaatgtgggaaaagcaaggat

SEQ ID NO: 631 - DNA, 201 bp, Homo sapiens
tcaaactctggcacgagctaagaaaaggaaggagaatttctggggtaaaacataaacctagctgagttgcctttatctaaggaaacattggcataattttwctttattgcttactgtgttaaaattttttgagtgaagtttttcctaacgttttctactttgaaatatttaatttccaatagaacagtttacttggaaatt

SEQ ID NO: 632 - DNA, 201 bp, Homo sapiens
acataaacctagctgagttgcctttatctaaggaaacattggcataatttttctttattgcttactgtgttaaaattttttgagtgaagtttttcctaacrttttctactttgaaatatttaatttccaatagaacagtttacttggaaattgttaacataggcttatacaaatttaacttttaaagaattctttttacat

SEQ ID NO: 633 - DNA, 201 bp, Homo sapiens; identical to SEQ ID NO: 624

SEQ ID NO: 634 - DNA, 201 bp, Homo sapiens; identical to SEQ ID NO: 625

SEQ ID NO: 635 - DNA, 201 bp, Homo sapiens
taggcatattcactgcatttcttttcaaaagcatagaattcttcattggtttcattgtcatttctgtaatattacattttgtgtttcagaattttccattrttgttttcttgtctaatgtctataagaatagttgataacaggctgttgactttagttattgtgaattagttctattctgactactcgctattttgtagta

SEQ ID NO: 636 - DNA, 201 bp, Homo sapiens
tcaatgctttccacatttctttctccattctgttccactgctcttctctggttcatgtccaccactgactgggaccctgaagaggcatttcagagtgttgkagaagaatctgtagcttgttgaaaaagctgggggtgaaagggaacaaggaaggtgatgtgtgagtctggcaggcaggagaaggggtgttcatagaagcag

SEQ ID NO: 637 - DNA, 201 bp, Homo sapiens
ctgggatgcctaatagtcctttgatagaaaggaattttaaatagtttgacacttgaaaaaagatactatttataagttgaagaaagtttgctgtaccacawtgcgcatgtagttaacaattttgcactgtagatttaacattttgttaagaggatagatttcatgttatgcattttttaccacaatttttaaaaagtttga

SEQ ID NO: 638 - DNA, 201 bp, Homo sapiens
gaaaggaattttaaatagtttgacacttgaaaaaagatactatttataagttgaagaaagtttgctgtaccacaatgcgcatgtagttaacaattttgcastgtagatttaacattttgttaagaggatagatttcatgttatgcattttttaccacaatttttaaaaagtttgaatagaaatttttaatgtctttgagtg

SEQ ID NO: 639 - DNA, 201 bp, Homo sapiens
gttccttcatataatgccttgagaaattctgaatatcaaaggcagtttgtttggaagacttctaaagaaactgctccagcttttgcagccaatcaggtagyttaatggatgtaatacatttctgagtaccattatcttatctagtaatgtagatttacatagaattaagagttgaaagaaattaagtacttaagtagcctg

SEQ ID NO: 640 - DNA, 201 bp, Homo sapiens
atctaggcgtgggagagcaaataaccactgtttctgctattgatgcagatgaacttcagttggtacagtatcagattgaagctggaaatgaactggatttstttagtttaaaccccaactcgggggtattgtcattaaagcgatcgctaatggatggcttaggtgcaaaggtgtctttccacagtctgagaatcacagcta

SEQ ID NO: 641 - DNA, 201 bp, Homo sapiens
tttatcacatcctcaacccagatcgcagatttaaaataagccgcacttcaggagttctgtcaaccactggcacgcccttcgatcgtgagcagcaggaggcrtttgatgtggttgtagaagtgacagaggaacataagccttctgcagtggcccacgttgtcgtgaaggtcattgtagaagaccaaaatgataatgcgccgg

SEQ ID NO: 642 - DNA, 201 bp, Homo sapiens
taatggtaaaagctacagataagggcagtccaccaatgagtgaaataacttctgtgcgtatctttgtcacaattgctgacaacgcctctccgaagtttacrtcaaaagaatattctgttgaacttagtgaaactgtcagcattgggagtttcgttgggatggttacagcccatagtcaatcatcagtggtgtatgaaataa

SEQ ID NO: 643 - DNA, 201 bp, Homo sapiens
acaatggtagtccccccaaatcaaccattgcaagagtcattgtgaaaatccttgatgaaaatgacaacaaacctcagtttctgcaaaagttctacaaaatyagactccctgagcgggaaaagccagaccgagaaagaaatgccagacgggagccgctctatcacgtcatagccaccgacaaggatgagggccccaatgcag

SEQ ID NO: 644 - DNA, 201 bp, Homo sapiens
taggcgtgggagagcaaataaccactgtttctgctattgatgcagatgaacttcagttggtacagtatcagattgaagctggaaatgaactggatttgttyagtttaaaccccaactcgggggtattgtcattaaagcgatcgctaatggatggcttaggtgcaaaggtgtctttccacagtctgagaatcacagctacag

SEQ ID NO: 645 - DNA, 201 bp, Homo sapiens
ctccacagccattgtggatgttaccgtcaccgatgtcaacgatagtccaccacgattcacggccgagatctataaagggactgtgagtgaggatgaccccyaaggtggggtgattgccatcttaagtaccacggatgctgattctgaagagatcaacagacaagttacatatttcataacaggaggggatcctttaggaca

SEQ ID NO: 646 - DNA, 201 bp, Homo sapiens
ttccgatcactgtcatgaataaagccatgcctgtgtttgaaaaacctttctacagtgcagagattgcagagagcatccaggtgcacagccctgtggtccaygtgcaggctaacagcccggaaggcctgaaagtgttctacagcatcacagacggagaccctttcagccagttcactattaacttcaatactggagttatca

SEQ ID NO: 647 - DNA, 201 bp, Homo sapiens
ctgtagacagagacagtggcagaaacggggaagtgcattactacctcaaggaacatcatgaacactttcaaattggacccttgggtgaaatttcactgaaraagcaatttgagcttgacaccttaaataaagaatatcttgttacagtggttgcaaaagatggagggaacccggccttttcagcggaagttatcgttccga

SEQ ID NO: 648 - DNA, 201 bp, Homo sapiens
cacggtcatggtacgagatcaagatgtgcctgtaaaacgcaactttgcaaggattgtggtcaatgtcagcgacacgaatgaccacgccccgtggttcaccrcttcctcctacaaagggcgggtttatgaatcggcagccgttggctcagttgtgttgcaggtgacggctctggacaaggacaaagggaaaaatgctgaagt

SEQ ID NO: 649 - DNA, 201 bp, Homo sapiens
gtagtaacagatgaggattcttcccataacggtccacccttcttctttactattgtaactggaaatgatgagaaggcttttgaagttaacccgcaaggagycctcctgacatcatctgccatcaagaggaaggagaaagatcattacttactgcaggtgaaggtggcagataatggaaagcctcagttgtcatctttgaca

SEQ ID NO: 650 - DNA, 201 bp, Homo sapiens
atctgttgttcttgtctatgttaaaatccttccaccggaaatgcagcttccaaaattttcagaacctttctatacctttacagtgtcagaggacgtgcctrttggaacagagatagatctcatccgagcagaacatagtgggactgttctttacagcctggtcaaagggaatactccagaaagcaatagggatgagtcctt

SEQ ID NO: 651 - DNA, 201 bp, Homo sapiens
ccggccttacctctgtcaaaattaatgtgaaagaaagcaaagaaagtcacctaaagtttacccaggatgtctactctgcggtagtgaaagagaattccacygaggccgaaacattagctgtcattactgctattgggaatccaatcaatgagcctttgttttatcacatcctcaacccagatcgcagatttaaaataagcc

SEQ ID NO: 652 - DNA, 201 bp, Homo sapiens
aatttacccagacagcgtacaaagctgcttttgatgagaacgtgcccattggtactactgtcatgagcctgagtgccgtagaccctgatgagggtgagaaygggtacgtgacatacagtatcgcaaatttaaatcatgtgccgtttgcgattgaccatttcactggtgccgtgagtacgtcagaaaacctggactacgaac

SEQ ID NO: 653 - DNA, 144 bp, Homo sapiens
ctgggcggccgggcgcggggagagggcgcgggagcggctcgtgyggcaggtaccatgcggacgcgcgagcccggcgagggccccggcaggcccggtccctgctcgggggcgcgctgagacggcgggtgagctccacgagagcgc

SEQ ID NO: 654 - DNA, 142 bp, Homo sapiens
ctgggcggccgggcgcggggagagggcgcgggagcggctcgygcggcaggtaccatgcggacgcgcgagcccggcgagggccccggcaggcccggtccctgctcgggggcgcgctgagacggcgggtgagctccacgagagc

SEQ ID NO: 655 - DNA, 201 bp, Homo sapiens
attgtcaccatcagaactggacagggacccagcatatgcaattgtgacagtggatgactgcgatcagggtgccaatggtgacatagcatctttaagcatcrtggcaggtgaccttctccagcagtttagaacagtgaggtcctttccagggagtaaggagtataaagtcaaagccatcggtggcattgattgggacagtca

SEQ ID NO: 656 - DNA, 201 bp, Homo sapiens
ataaggaccaaaggaggaaatacagctattcttaatagagaagtgaaggatcactacacattgatagtgaaagcacttgaaaaaaatactaatgtggaggygcgaacaaaggtcagggtgcaggtgctggatacaaatgacttgagaccgttattctcacccacctcatacagcgtttctttacctgaaaacacagctata

SEQ ID NO: 657 - DNA, 201 bp, Homo sapiens
tggtatcagttttccatactggccaggtgcactcaagatgaccatgagatggtggcttctgtagatgttagtatccaagtgaaagatgcaaatgacaacarcccggtctttgaatctagtccatatgaggcattcattgttgaaaacctgccagggggaagtagagtaattcagatcagggcatctgatgctgactcagga

SEQ ID NO: 658 - DNA, 201 bp, Homo sapiens
tctacagcatcacagacggagaccctttcagccagttcactattaacttcaatactggagttatcaatgtcatagctcctctggactttgaggcccacccrgcatataagctgagcatacgcgcaactgactccttgacgggcgctcatgctgaagtatttgtggacatcatagtagacgacatcaatgataaccctcctg

SEQ ID NO: 659 - DNA, 201 bp, Homo sapiens
gtgaatcagcctcaattaacagcgtggtcctaacagacaggaatgtcccactggtgattcgagcagctgatgctgataaagactcaaatgctttgcttgtrtatcacattgttgaaccatctgtacacacatattttgctattgattctagcactggtgctattcatacagtactaagtctggactatgaagaaacaagta

SEQ ID NO: 660 - DNA, 201 bp, Homo sapiens
gacaacaaacctcagtttctgcaaaagttctacaaaatcagactccctgagcgggaaaagccagaccgagaaagaaatgccagacgggagccgctctatcrcgtcatagccaccgacaaggatgagggccccaatgcagaaatctcctacagcatcgaagacgggaatgagcatggcaaatttttcatcgaaccgaaaact

SEQ ID NO: 661 - DNA, 201 bp, Homo sapiens
tgtggaagtgagtgaagacaaggaggtacatagtgaaatcatccaggttgaagccacagataaagacctggggcccaacggacacgtgacgtactcaattsttacagacacagacacattttcaattgacagcgtgacgggtgttgttaacatcgcacgccctctggatcgagagctgcagcatgagcactccttaaagat

SEQ ID NO: 662 - DNA, 201 bp, Homo sapiens
gttggctcagttgtgttgcaggtgacggctctggacaaggacaaagggaaaaatgctgaagtgctgtactcgatcgagtcaggtacttttggagaaatatyggaaattcttttatgattgatcctgtcttgggctctattaaaactgccaaagaattagatcgaagtaaccaagcggagtatgatttaatggtaaaagcta

SEQ ID NO: 663 - DNA, 201 bp, Homo sapiens
caagccagagaagagcctcagctgttctccactgtcgttgtgaaagtatcactagaagatgttaatgacaacccacctacatttattccacctaattatcrtgtgaaagtccgagaggatcttccagaaggaaccgtcatcatgtggttagaagcccacgatcctgatttaggtcagtctggtcaggtgagatacagcctt

SEQ ID NO: 664 - DNA, 201 bp, Homo sapiens
agtatcagattgaagctggaaatgaactggatttgtttagtttaaaccccaactcgggggtattgtcattaaagcgatcgctaatggatggcttaggtgcraaggtgtctttccacagtctgagaatcacagctacagatggagaaaattttgccacaccattatatatcaacataacagtggctgccagtcacaagctgg

SEQ ID NO: 665 - DNA, 201 bp, Homo sapiens
ggaaccaacggggaattttactacagttttaaagatcgaacagatatgtttgctattcacccaaccagtggtgtgatagtgttaactggtagacttgattwcctagagaccaagctctatgagatggaaatcctcgctgcggaccgtggcatgaagttgtatgggagcagtggcatcagcagcatggccaagctaacggtg

SEQ ID NO: 666 - DNA, 201 bp, Homo sapiens
ccccggcaggcccggtccctgctcgggggcgcgctgagacggcgggtgagctccacgagagcgccgtcgccacttcgggccaactttgcgattcccgacakttaagcaatggggagacatttggctttgctcctgcttctgctccttctcttccaacattttggagacagtgatggcagccaacgacttgaacagactcct

SEQ ID NO: 667 - DNA, 201 bp, Homo sapiens
catggcaaatttttcatcgaaccgaaaactggagtggtttcgtccaagaggttttcagcagctggagaatatgatattctttcaattaaggcagttgacartggtcgccctcaaaagtcatcaaccaccagactccatattgaatggatctccaagcccaaaccgtccctggagcccatttcatttgaagaatcatttttt

SEQ ID NO: 668 - DNA, 201 bp, Homo sapiens
gggtgattgccatcttaagtaccacggatgctgattctgaagagatcaacagacaagttacatatttcataacaggaggggatcctttaggacagtttgcygttgaaactatacagaatgaatggaaggtatatgtgaagaaacctctagacagggaaaaaagggacaattaccttcttactatcacggcaactgatggca

SEQ ID NO: 669 - DNA, 201 bp, Homo sapiens
tctttgaatctagtccatatgaggcattcattgttgaaaacctgccagggggaagtagagtaattcagatcagggcatctgatgctgactcaggaaccaayggccaagttatgtatagcctggatcagtcacaaagtgtggaagtcattgaatcctttgccattaacatggaaacaggctggattacaactttaaaggaac

SEQ ID NO: 670 - DNA, 201 bp, Homo sapiens
ctctggactttgaggcccacccggcatataagctgagcatacgcgcaactgactccttgacgggcgctcatgctgaagtatttgtggacatcatagtagasgacatcaatgataaccctcctgtgtttgctcagcagtcttatgcggtgaccctgtctgaggcatctgtaattggaacgtctgttgttcaagttagagcca

SEQ ID NO: 671 - DNA, 201 bp, Homo sapiens
cagccgttggctcagttgtgttgcaggtgacggctctggacaaggacaaagggaaaaatgctgaagtgctgtactcgatcgagtcaggtacttttggagaratattggaaattcttttatgattgatcctgtcttgggctctattaaaactgccaaagaattagatcgaagtaaccaagcggagtatgatttaatggtaaa

SEQ ID NO: 672 - DNA, 201 bp, Homo sapiens
agaccaagctctatgagatggaaatcctcgctgcggaccgtggcatgaagttgtatgggagcagtggcatcagcagcatggccaagctaacggtgcacatygaacaggccaatgaatgtgctccggtgataacagcagtgacattgtcaccatcagaactggacagggacccagcatatgcaattgtgacagtggatgact

SEQ ID NO: 673 - DNA, 201 bp, Homo sapiens
cccacccgtgttttccagctttgtggaaaaggggacagtgaaagaagatgcacctgttggttcattggtaatgacggtgtcggctcatgatgaggacgccrgaagagatggggagatccgatactccattagagatggctctggcgttggtgttttcaaaataggtgaagagacaggtgtcatagagacgtcagatcgact

SEQ ID NO: 674 - DNA, 201 bp, Homo sapiens
aagccagtgggcttcagcgtgctgcagctggtagtaacagatgaggattcttcccataacggtccacccttcttctttactattgtaactggaaatgatgrgaaggcttttgaagttaacccgcaaggagtcctcctgacatcatctgccatcaagaggaaggagaaagatcattacttactgcaggtgaaggtggcagat

SEQ ID NO: 675 - DNA, 201 bp, Homo sapiens
cccttgatcgtgaggagcaagctgtttatcatcttctcgtcagggccacagatggaggaggaagattctgccaagccagtattgtgctcacgctagaagaygtgaacgataacgcccccgaattctctgccgatccttatgccatcaccgtgtttgaaaacacagagccgggaacgctgctgacaagagtgcaggccacag

SEQ ID NO: 676 - DNA, 201 bp, Homo sapiens
tggaaagcctcagttgtcatctttgacatacattgacattagggtaattgaggagagcatctatccgcctgcgattttgcccctggagattttcatcacckcttctggagaagaatactcaggtggcgtcattgggaagatccatgccacagaccaggacgtgtatgatactctaacctacagtctcgaccctcagatgga

SEQ ID NO: 677 - DNA, 201 bp, Homo sapiens
tattacctaacagtagaggccactgatggaggcacgccttcactgagcgacgttgccactgtgaacgttaatgtaacagatatcaacgataatacccctgygttcagccaagacacctacacgacagtcatcagtgaagatgccgttcttgagcagtctgtcatcacggttatggccgatgatgccgatggaccttccaac

SEQ ID NO: 678 - DNA, 201 bp, Homo sapiens
actgatggcaccttctcatcaaaagcgatagttgaagtgaaagttctggatgcaaatgacaacagtccagtttgtgaaaagactttatattcagacactaytcctgaagacgtccttcctggaaaattgatcatgcagatctctgctacagacgcagacatccgctctaacgctgaaattacttacacgttattgggttca

SEQ ID NO: 679 - DNA, 201 bp, Homo sapiens
aaccaagcggagtatgatttaatggtaaaagctacagataagggcagtccaccaatgagtgaaataacttctgtgcgtatctttgtcacaattgctgacarcgcctctccgaagtttacatcaaaagaatattctgttgaacttagtgaaactgtcagcattgggagtttcgttgggatggttacagcccatagtcaatca

SEQ ID NO: 680 - DNA, 201 bp, Homo sapiens
cacagctacagatggagaaaattttgccacaccattatatatcaacataacagtggctgccagtcacaagctggtaaacttgcagtgtgaagagactggtrttgccaaaatgctggcagagaagctcctgcaggcaaataaattacacaaccagggagaggtggaggatattttcttcgattctcactctgtcaatgctca

SEQ ID NO: 681 - DNA, 201 bp, Homo sapiens
cggcgagggccccggcaggcccggtccctgctcgggggcgcgctgagacggcgggtgagctccacgagagcgccgtcgccacttcgggccaactttgcgaytcccgacagttaagcaatggggagacatttggctttgctcctgcttctgctccttctcttccaacattttggagacagtgatggcagccaacgacttgaa

SEQ ID NO: 682 - DNA, 201 bp, Homo sapiens
gtcatgatcattttcatgtagacagcagcactggcctcatctcactactcagaaccctggattacgagcagtcccggcagcacacgatttttgtgagggcwgttgatggtggtatgcccacgctgagcagtgatgtgattgtcacggtggacgttaccgacctcaatgataatccaccactctttgaacaacagatttatg

SEQ ID NO: 683 - DNA, 201 bp, Homo sapiens
ctgagttttgtgactccccgccaccacagggcagcggtgtgtctctgcaaagagggaaggtgcccacctgtccaccatggctgtgaagatgatccgtgccmtgagggatccgaatgtgtgtctgatccctgggaggagaaacacacctgtgtctgtcccagcggcaggtttggtcagtgcccaggagattcatcatggaag

SEQ ID NO: 684 - DNA, 201 bp, Homo sapiens
ctctgaacctcacccacatctggacgtcttactttttgtagagaaaccaggtagtgctcagatctcaacaaaacaacttctgcacaagattaactcttccrtgactgacattgaggaaatcattggagttaggatactgaatgtattccagaaactctgcgcgggactggactgcccctggaagttctgcgatgaaaaggt

SEQ ID NO: 685 - DNA, 201 bp, Homo sapiens
ggtcttggtgaaagtcttaggtgcaaatagcaatccccctgaatttacccagacagcgtacaaagctgcttttgatgagaacgtgcccattggtactactrtcatgagcctgagtgccgtagaccctgatgagggtgagaatgggtacgtgacatacagtatcgcaaatttaaatcatgtgccgtttgcgattgaccattt

SEQ ID NO: 686 - DNA, 201 bp, Homo sapiens
tttacagagcagaaataagtgaatttgctcctcccaacacacctgtggtcatggtaaaggccattcctgcttattcccatttgaggtatgtttttaaaagkacacctggaaaagctaaattcagtttaaattacaacactggtctcatttctattttagaaccagttaaaagacagcaggcagcccattttgaacttgaag

SEQ ID NO: 687 - DNA, 201 bp, Homo sapiens
ctttcggctacaatctcacactacaggctaaagataaaggaactccgccccagttctcttctgttaaagtcattcacgtgacttctccacagttcaaagcygggccagtcaagtttgaaaaggatgtttacagagcagaaataagtgaatttgctcctcccaacacacctgtggtcatggtaaaggccattcctgcttatt

SEQ ID NO: 688 - DNA, 201 bp, Homo sapiens
tccacagccattgtggatgttaccgtcaccgatgtcaacgatagtccaccacgattcacggccgagatctataaagggactgtgagtgaggatgaccccchaggtggggtgattgccatcttaagtaccacggatgctgattctgaagagatcaacagacaagttacatatttcataacaggaggggatcctttaggacag

SEQ ID NO: 689 - DNA, 201 bp, Homo sapiens
gcgtttgcaatccgtcacctgctggaggttattactgcaaatgcagtgccttgtacatagggacccactgtgagataagcgtcaatccgtgttcctccaasccatgcctctatgggggcacgtgtgttgtcgacaacggaggctttgtttgccagtgtagaggattatatactggtcagaggtgtcagcttagtccatact

SEQ ID NO: 690 - DNA, 201 bp, Homo sapiens
gtagaggattatatactggtcagaggtgtcagcttagtccatactgcaaagatgaaccctgtaagaatggcggaacatgctttgacagtttggatggcgcygtttgtcagtgtgattcgggttttaggggagaaaggtgtcagagtgatatcgacgagtgctctggaaacccttgcctgcacggggccctctgtgagaaca

SEQ ID NO: 691 - DNA, 201 bp, Homo sapiens
agtacaggggacgtcactgcgaggatgctgcgcccaaccagtatgtgtccacgccgtggaacattgggttggcggaaggaattggaatcgttgtgtttgtygcagggatatttttactggtggtggtgtttgttctctgccgtaagatgattagtcggaaaaagaagcatcaggctgaacctaaagacaagcacctgggac

SEQ ID NO: 692 - DNA, 201 bp, Homo sapiens
cagagcatcccgaattcagcacttttaaccccgagtctgtgcacgggcaccgaaaagcagtggcggtctgcagcgtggcgccaaacctgcctcccccaccyccttcaaactccccttctgacagcgactccatccagaagcctagctgggactttgactatgacacaaaagtggtggatcttgatccctgtctttccaaga

SEQ ID NO: 693 - DNA, 201 bp, Homo sapiens
caaaagtggtggatcttgatccctgtctttccaagaagcctctagaggaaaagccttcccagccatacagtgcccgggaaagcctgtctgaagtgcagtcyctgagctccttccagtccgaatcgtgcgatgacaatgggtatcactgggatacatcagattggatgccaagcgttcctctgccggacatacaagagttcc

SEQ ID NO: 694 - DNA, 201 bp, Homo sapiens
tgcagtctctgagctccttccagtccgaatcgtgcgatgacaatgggtatcactgggatacatcagattggatgccaagcgttcctctgccggacatacargagttccccaactatgaggtgattgatgagcagacacccctgtactcagcagatccaaacgccatcgatacggactattaccctggaggctacgacatcg

SEQ ID NO: 695 - DNA, 201 bp, Homo sapiens
acaatgggtatcactgggatacatcagattggatgccaagcgttcctctgccggacatacaagagttccccaactatgaggtgattgatgagcagacaccyctgtactcagcagatccaaacgccatcgatacggactattaccctggaggctacgacatcgaaagtgattttcctccacccccagaagacttccccgcag

SEQ ID NO: 696 - DNA, 201 bp, Homo sapiens
gctaccaccgttaccgcccgaattcagcaatcagtttgaatccatccaccctcctagagacatgcctgccgcgggtagcttgggttcttcatcaagaaacyggcagaggttcaacttgaatcagtatttgcccaatttttatcccctcgatatgtctgaacctcaaacaaaaggcactggtgagaatagtacttgtagaga

SEQ ID NO: 697 - DNA, 201 bp, Homo sapiens
tgcccatgtctgtgtacgcctccaccgcctcctgctctgacgtgtcagcctgctgcgaagtggagtccgaggtcatgatgagtgactatgagagcggggamgacggccacttcgaagaggtgacgatcccgcccctggattcccagcagcacacggaagtctgactctcaactccccccaaagtgcctgactttagtgaac

SEQ ID NO: 698 - DNA, 201 bp, Homo sapiens
ttccagtgtcccaactactgtcatcgtgaggttttcatcggctgtgccatttcccaacgtcttttgggatttacatctgtctgtgttaaaataatcaaacraaaaatcagtcctgtgttgtcagcatgattcatgtatttatatagatttgattattttaattttcctgtctcttttttttgtaaattttatgtacagatt

SEQ ID NO: 699 - DNA, 201 bp, Homo sapiens
ctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacattt

SEQ ID NO: 700 - DNA, 201 bp, Homo sapiens
tcttttttttgtaaattttatgtacagatttgatttttcatagttttaactagatttccaagatattttgtgcatttgtttcaactgaattttggtggtgkcagtgccattatctagcaccctgatttttttttttttactataaccagggtttcattctgtctttttccactgaagtgtgacattttgttagtacatttc

SEQ ID NO: 701 - DNA, 201 bp, Homo sapiens
cttttttttgtaaattttatgtacagatttgatttttcatagttttaactagatttccaagatattttgtgcatttgtttcaactgaattttggtggtgtyagtgccattatctagcaccctgatttttttttttttactataaccagggtttcattctgtctttttccactgaagtgtgacattttgttagtacatttca

SEQ ID NO: 702 - DNA, 201 bp, Homo sapiens
agatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgt

SEQ ID NO: 703 - DNA, 201 bp, Homo sapiens
tgccattatctagcaccctgatttttttttttttactataaccagggtttcattctgtctttttccactgaagtgtgacattttgttagtacatttcagtrtagtcattcatttctagctgtacataggatgaaggagagatcagatacatgaacatgtcttacatgggttgctgtatttagaattataaacatttttcat

SEQ ID NO: 704 - DNA, 201 bp, Homo sapiens; identical to SEQ ID NO: 640

SEQ ID NO: 705 - DNA, 201 bp, Homo sapiens; identical to SEQ ID NO: 641

SEQ ID NO: 706 - DNA, 201 bp, Homo sapiens; identical to SEQ ID NO: 642

SEQ ID NO: 707 - DNA, 201 bp, Homo sapiens; identical to SEQ ID NO: 643

SEQ ID NO: 708 - DNA, 201 bp, Homo sapiens; identical to SEQ ID NO: 644

SEQ ID NO: 709 - DNA, 201 bp, Homo sapiens; identical to SEQ ID NO: 645

SEQ ID NO: 710 - DNA, 201 bp, Homo sapiens; identical to SEQ ID NO: 646

SEQ ID NO: 711 - DNA, 201 bp, Homo sapiens; identical to SEQ ID NO: 647

SEQ ID NO: 712 - DNA, 201 bp, Homo sapiens; identical to SEQ ID NO: 648

SEQ ID NO: 713 - DNA, 201 bp, Homo sapiens; identical to SEQ ID NO: 650

SEQ ID NO: 714 - DNA, 201 bp, Homo sapiens; identical to SEQ ID NO: 651

SEQ ID NO: 715 - DNA, 201 bp, Homo sapiens; identical to SEQ ID NO: 652

SEQ ID NO: 716 - DNA, 144 bp, Homo sapiens; identical to SEQ ID NO: 653

SEQ ID NO: 717 - DNA, 142 bp, Homo sapiens; identical to SEQ ID NO: 654

SEQ ID NO: 718 - DNA, 201 bp, Homo sapiens; identical to SEQ ID NO: 655

SEQ ID NO: 719 - DNA, 201 bp, Homo sapiens; identical to SEQ ID NO: 656

SEQ ID NO: 720 - DNA, 201 bp, Homo sapiens; identical to SEQ ID NO: 657

SEQ ID NO: 721 - DNA, 201 bp, Homo sapiens; identical to SEQ ID NO: 658

SEQ ID NO: 722 - DNA, 201 bp, Homo sapiens; identical to SEQ ID NO: 659

SEQ ID NO: 723 - DNA, 201 bp, Homo sapiens; identical to SEQ ID NO: 660

SEQ ID NO: 724 - DNA, 201 bp, Homo sapiens; identical to SEQ ID NO: 661

SEQ ID NO: 725 - DNA, 201 bp, Homo sapiens
aatcggcagccgttggctcagttgtgttgcaggtgacggctctggacaaggacaaagggaaaaatgctgaagtgctgtactcgatcgagtcaggaaatatyggaaattcttttatgattgatcctgtcttgggctctattaaaactgccaaagaattagatcgaagtaaccaagcggagtatgatttaatggtaaaagcta

SEQ ID NO: 726 - DNA, 201 bp, Homo sapiens; identical to SEQ ID NO: 663

SEQ ID NO: 727 - DNA, 201 bp, Homo sapiens; identical to SEQ ID NO: 664

SEQ ID NO: 728 - DNA, 201 bp, Homo sapiens; identical to SEQ ID NO: 665

SEQ ID NO: 729 - DNA, 201 bp, Homo sapiens; identical to SEQ ID NO: 666

SEQ ID NO: 730 - DNA, 201 bp, Homo sapiens; identical to SEQ ID NO: 667

SEQ ID NO: 731 - DNA, 201 bp, Homo sapiens; identical to SEQ ID NO: 668

SEQ ID NO: 732 - DNA, 201 bp, Homo sapiens; identical to SEQ ID NO: 669

SEQ ID NO: 733 - DNA, 201 bp, Homo sapiens; identical to SEQ ID NO: 670

SEQ ID NO: 734 - DNA, 201 bp, Homo sapiens
ttatgaatcggcagccgttggctcagttgtgttgcaggtgacggctctggacaaggacaaagggaaaaatgctgaagtgctgtactcgatcgagtcaggaratattggaaattcttttatgattgatcctgtcttgggctctattaaaactgccaaagaattagatcgaagtaaccaagcggagtatgatttaatggtaaa

SEQ ID NO: 735 - DNA, 201 bp, Homo sapiens; identical to SEQ ID NO: 672

SEQ ID NO: 736 - DNA, 201 bp, Homo sapiens; identical to SEQ ID NO: 673

SEQ ID NO: 737 - DNA, 201 bp, Homo sapiens; identical to SEQ ID NO: 675

SEQ ID NO: 738 - DNA, 201 bp, Homo sapiens
tattacctaacagtagaggccactgatggaggcacgccttcactgagcgacgttgccactgtgaacgttaatgtaacagatatcaacgataatacccctgygttcagccaagacacctacacgacagtcatcagtgaagatgccgttcttgagcagtctgtcatcacggttacacgctcacggttcaagcttctgataatg

SEQ ID NO: 739 - DNA, 201 bp, Homo sapiens; identical to SEQ ID NO: 678

SEQ ID NO: 740 - DNA, 201 bp, Homo sapiens; identical to SEQ ID NO: 679

SEQ ID NO: 741 - DNA, 201 bp, Homo sapiens; identical to SEQ ID NO: 680

SEQ ID NO: 742 - DNA, 201 bp, Homo sapiens; identical to SEQ ID NO: 681

SEQ ID NO: 743 - DNA, 201 bp, Homo sapiens; identical to SEQ ID NO: 682

SEQ ID NO: 744 - DNA, 201 bp, Homo sapiens; identical to SEQ ID NO: 685

SEQ ID NO: 745 - DNA, 201 bp, Homo sapiens; identical to SEQ ID NO: 686

SEQ ID NO: 746 - DNA, 201 bp, Homo sapiens; identical to SEQ ID NO: 687

SEQ ID NO: 747 - DNA, 201 bp, Homo sapiens; identical to SEQ ID NO: 688

SEQ ID NO: 748 - DNA, 201 bp, Homo sapiens; identical to SEQ ID NO: 674

SEQ ID NO: 749 - DNA, 201 bp, Homo sapiens; identical to SEQ ID NO: 649

SEQ ID NO: 750 - DNA, 201 bp, Homo sapiens; identical to SEQ ID NO: 684

SEQ ID NO: 751 - DNA, 201 bp, Homo sapiens
ctgagttttgtgactccccgccaccacagggcagcggtgtgtctctgcaaagagggaaggtgcccacctgtccaccatggctgtgaagatgatccgtgccmtgagggatccgaatgtgtgtctgatccctgggaggagaaacacacctgtgtctgtcccagcggcaggtttggtcagtgcccaggcagaggttgcagtgag

SEQ ID NO: 752 - DNA, 201 bp, Homo sapiens
ggtcagtgcccaggcagaggttgcagtgagttgagatcacgccactgcactccagcctgggcgacaagagtgaaactgtctcaaaaaacaaaaactgttayagtttatagagacatcctacatgtgtttcaaattcatcatggaaggctgcagtacaagtttgactgtggaagtggccctggaattgtctctgttcagagc

SEQ ID NO: 753 - DNA, 201 bp, Homo sapiens
gtgagttgagatcacgccactgcactccagcctgggcgacaagagtgaaactgtctcaaaaaacaaaaactgttacagtttatagagacatcctacatgtrtttcaaattcatcatggaaggctgcagtacaagtttgactgtggaagtggccctggaattgtctctgttcagagcattcaggtcaatgatgggcagtggc

SEQ ID NO: 754 - DNA, 201 bp, Homo sapiens; identical to SEQ ID NO: 689

SEQ ID NO: 755 - DNA, 201 bp, Homo sapiens; identical to SEQ ID NO: 690

SEQ ID NO: 756 - DNA, 201 bp, Homo sapiens; identical to SEQ ID NO: 691

SEQ ID NO: 757 - DNA, 201 bp, Homo sapiens; identical to SEQ ID NO: 692

SEQ ID NO: 758 - DNA, 201 bp, Homo sapiens; identical to SEQ ID NO: 693

SEQ ID NO: 759 - DNA, 201 bp, Homo sapiens; identical to SEQ ID NO: 694

SEQ ID NO: 760 - DNA, 201 bp, Homo sapiens; identical to SEQ ID NO: 695

SEQ ID NO: 761 - DNA, 201 bp, Homo sapiens; identical to SEQ ID NO: 696

SEQ ID NO: 762 - DNA, 201 bp, Homo sapiens; identical to SEQ ID NO: 697

SEQ ID NO: 763 - DNA, 201 bp, Homo sapiens; identical to SEQ ID NO: 698

SEQ ID NO: 764 - DNA, 201 bp, Homo sapiens; identical to SEQ ID NO: 699

SEQ ID NO: 765 - DNA, 201 bp, Homo sapiens; identical to SEQ ID NO: 700

SEQ ID NO: 766 - DNA, 201 bp, Homo sapiens; identical to SEQ ID NO: 701

SEQ ID NO: 767 - DNA, 201 bp, Homo sapiens; identical to SEQ ID NO: 702

SEQ ID NO: 768 - DNA, 201 bp, Homo sapiens; identical to SEQ ID NO: 703

SEQ ID NO: 769 - DNA, 201 bp, Homo sapiens; identical to SEQ ID NO: 640

SEQ ID NO: 770 - DNA, 201 bp, Homo sapiens; identical to SEQ ID NO: 641

SEQ ID NO: 771 - DNA, 201 bp, Homo sapiens; identical to SEQ ID NO: 642

SEQ ID NO: 772 - DNA, 201 bp, Homo sapiens; identical to SEQ ID NO: 643

SEQ ID NO: 773 - DNA, 201 bp, Homo sapiens; identical to SEQ ID NO: 644

SEQ ID NO: 774 - DNA, 201 bp, Homo sapiens; identical to SEQ ID NO: 645

SEQ ID NO: 775 - DNA, 201 bp, Homo sapiens; identical to SEQ ID NO: 646

SEQ ID NO: 776 - DNA, 201 bp, Homo sapiens; identical to SEQ ID NO: 647

SEQ ID NO: 777 - DNA, 201 bp, Homo sapiens; identical to SEQ ID NO: 648

SEQ ID NO: 778 - DNA, 201 bp, Homo sapiens; identical to SEQ ID NO: 649

SEQ ID NO: 779 - DNA, 201 bp, Homo sapiens; identical to SEQ ID NO: 650

SEQ ID NO: 780 - DNA, 201 bp, Homo sapiens; identical to SEQ ID NO: 651

SEQ ID NO: 781 - DNA, 201 bp, Homo sapiens; identical to SEQ ID NO: 652

SEQ ID NO: 782 - DNA, 144 bp, Homo sapiens; identical to SEQ ID NO: 653

SEQ ID NO: 783 - DNA, 142 bp, Homo sapiens; identical to SEQ ID NO: 654

SEQ ID NO: 784 - DNA, 201 bp, Homo sapiens; identical to SEQ ID NO: 655

SEQ ID NO: 785 - DNA, 201 bp, Homo sapiens; identical to SEQ ID NO: 656

SEQ ID NO: 786 - DNA, 201 bp, Homo sapiens; identical to SEQ ID NO: 657

SEQ ID NO: 787 - DNA, 201 bp, Homo sapiens; identical to SEQ ID NO: 658

SEQ ID NO: 788 - DNA, 201 bp, Homo sapiens; identical to SEQ ID NO: 659

SEQ ID NO: 789 - DNA, 201 bp, Homo sapiens; identical to SEQ ID NO: 660

SEQ ID NO: 790 - DNA, 201 bp, Homo sapiens; identical to SEQ ID NO: 661

SEQ ID NO: 791 - DNA, 201 bp, Homo sapiens
ccgttggctcagttgtgttgcaggtgacggctctggacaaggacaaagggaaaaatgctgaagtgctgtactcgatcgagtcaggtacttttggaaatatyggaaattcttttatgattgatcctgtcttgggctctattaaaactgccaaagaattagatcgaagtaaccaagcggagtatgatttaatggtaaaagcta

SEQ ID NO: 792 - DNA, 201 bp, Homo sapiens; identical to SEQ ID NO: 663

SEQ ID NO: 793 - DNA, 201 bp, Homo sapiens; identical to SEQ ID NO: 664

SEQ ID NO: 794 - DNA, 201 bp, Homo sapiens; identical to SEQ ID NO: 665

SEQ ID NO: 795 - DNA, 201 bp, Homo sapiens; identical to SEQ ID NO: 666

SEQ ID NO: 796 - DNA, 201 bp, Homo sapiens; identical to SEQ ID NO: 667

SEQ ID NO: 797 - DNA, 201 bp, Homo sapiens; identical to SEQ ID NO: 668

SEQ ID NO: 798 - DNA, 201 bp, Homo sapiens; identical to SEQ ID NO: 669

SEQ ID NO: 799 - DNA, 201 bp, Homo sapiens; identical to SEQ ID NO: 670

SEQ ID NO: 800 - DNA, 201 bp, Homo sapiens
ggcagccgttggctcagttgtgttgcaggtgacggctctggacaaggacaaagggaaaaatgctgaagtgctgtactcgatcgagtcaggtacttttggaratattggaaattcttttatgattgatcctgtcttgggctctattaaaactgccaaagaattagatcgaagtaaccaagcggagtatgatttaatggtaaa

SEQ ID NO: 801 - DNA, 201 bp, Homo sapiens; identical to SEQ ID NO: 672

SEQ ID NO: 802 - DNA, 201 bp, Homo sapiens; identical to SEQ ID NO: 673

SEQ ID NO: 803 - DNA, 201 bp, Homo sapiens; identical to SEQ ID NO: 674

SEQ ID NO: 804 - DNA, 201 bp, Homo sapiens; identical to SEQ ID NO: 675

SEQ ID NO: 805 - DNA, 201 bp, Homo sapiens; identical to SEQ ID NO: 676

SEQ ID NO: 806 - DNA, 201 bp, Homo sapiens; identical to SEQ ID NO: 677

SEQ ID NO: 807 - DNA, 201 bp, Homo sapiens; identical to SEQ ID NO: 678

SEQ ID NO: 808 - DNA, 201 bp, Homo sapiens; identical to SEQ ID NO: 679

SEQ ID NO: 809 - DNA, 201 bp, Homo sapiens; identical to SEQ ID NO: 680

SEQ ID NO: 810 - DNA, 201 bp, Homo sapiens; identical to SEQ ID NO: 681

SEQ ID NO: 811 - DNA, 201 bp, Homo sapiens; identical to SEQ ID NO: 682

SEQ ID NO: 812 - DNA, 201 bp, Homo sapiens; identical to SEQ ID NO: 683

SEQ ID NO: 813 - DNA, 201 bp, Homo sapiens; identical to SEQ ID NO: 684

SEQ ID NO: 814 - DNA, 201 bp, Homo sapiens; identical to SEQ ID NO: 685

SEQ ID NO: 815 - DNA, 201 bp, Homo sapiens; identical to SEQ ID NO: 686

SEQ ID NO: 816 - DNA, 201 bp, Homo sapiens; identical to SEQ ID NO: 687

SEQ ID NO: 817 - DNA, 201 bp, Homo sapiens; identical to SEQ ID NO: 688

SEQ ID NO: 818 - DNA, 201 bp, Homo sapiens; identical to SEQ ID NO: 689

SEQ ID NO: 819 - DNA, 201 bp, Homo sapiens; identical to SEQ ID NO: 690

SEQ ID NO: 820 - DNA, 201 bp, Homo sapiens; identical to SEQ ID NO: 691

SEQ ID NO: 821 - DNA, 201 bp, Homo sapiens; identical to SEQ ID NO: 692

SEQ ID NO: 822 - DNA, 201 bp, Homo sapiens; identical to SEQ ID NO: 693

SEQ ID NO: 823 - DNA, 201 bp, Homo sapiens; identical to SEQ ID NO: 694

SEQ ID NO: 824 - DNA, 201 bp, Homo sapiens; identical to SEQ ID NO: 695

SEQ ID NO: 825 - DNA, 201 bp, Homo sapiens; identical to SEQ ID NO: 696

SEQ ID NO: 826 - DNA, 201 bp, Homo sapiens; identical to SEQ ID NO: 697

SEQ ID NO: 827 - DNA, 201 bp, Homo sapiens; identical to SEQ ID NO: 698

SEQ ID NO: 828 - DNA, 201 bp, Homo sapiens; identical to SEQ ID NO: 699

SEQ ID NO: 829 - DNA, 201 bp, Homo sapiens; identical to SEQ ID NO: 700

SEQ ID NO: 830 - DNA, 201 bp, Homo sapiens; identical to SEQ ID NO: 701

SEQ ID NO: 831 - DNA, 201 bp, Homo sapiens; identical to SEQ ID NO: 702

SEQ ID NO: 832 - DNA, 201 bp, Homo sapiens; identical to SEQ ID NO: 703

SEQ ID NO: 833 - DNA, 171 bp, Homo sapiens
cgcaccgcctcttcctcctggaagctatataatgatatcgcgtcacttccgctctctcttccacaggaggyctacacgccgccgcttgtgctgcagccatgtctctagtgatccctgaaaagttccagcatattttgcgagtactcaacaccaacatcgatgggcggcgga

SEQ ID NO: 834 - DNA, 171 bp, Homo sapiens; identical to SEQ ID NO: 833

SEQ ID NO: 835 - DNA, 171 bp, Homo sapiens
cgcaccgcctcttcctcctggaagctatataatgatatcgcgtcacttccgctctctcttccacaggaggyctacacgccgccgcttgtgctgcagccatgtttactgtgtctgatttcttcccccgtactttttcaactagtctctagtgatccctgaaaagttccagca

SEQ ID NO: 836 - DNA, 171 bp, Homo sapiens; identical to SEQ ID NO: 833

SEQ ID NO: 837 - DNA, 201 bp, Homo sapiens
gcctcttcctcctggaagctatataatgatatcgcgtcacttccgctctctcttccacaggaggcctacacgccgccgcttgtgctgcagccatggtaagrctggaatccgtgccgtgatccagcggcatcgcagctcgggcaaggaaagccggctgtcagggttctggaaacgtcctgccctgagggcctgcgactttct

SEQ ID NO: 838 - DNA, 201 bp, Homo sapiens
ttgtgctgcagccatggtaagactggaatccgtgccgtgatccagcggcatcgcagctcgggcaaggaaagccggctgtcagggttctggaaacgtcctgycctgagggcctgcgactttctgtatggagccttggatcgcgtccctggaaagggacaccaaagatttccaattccggagagcgggcccgaggaagggtca

SEQ ID NO: 839 - DNA, 171 bp, Homo sapiens
cgcaccgcctcttcctcctggaagctatataatgatatcgcgtcacttccgctctctcttccacaggaggyctacacgccgccgcttgtgctgcagccatggtaagactggaatccgtgccgtgatccagcggcatcgcagctcgggcaaggaaagccggctgtcagggtt

SEQ ID NO: 840 - DNA, 201 bp, Homo sapiens
ttggatcgcgtccctggaaagggacaccaaagatttccaattccggagagcgggcccgaggaagggtcactgctcgggcgcacgaaagctgtctaaggctkgggcgtatatggggaactctggcttttgccacgcacttttgggaatgggcaggagacctgcttcctctctccagaggttgcattttcccaagcttgaacg

SEQ ID NO: 841 - DNA, 201 bp, Homo sapiens
ccacaggaggcctacacgccgccgcttgtgctgcagccatggtaagactggaatccgtgccgtgatccagcggcatcgcagctcgggcaaggaaagccggytgtcagggttctggaaacgtcctgccctgagggcctgcgactttctgtatggagccttggatcgcgtccctggaaagggacaccaaagatttccaattcc

SEQ ID NO: 842 - DNA, 201 bp, Homo sapiens; identical to SEQ ID NO: 837

SEQ ID NO: 843 - DNA, 201 bp, Homo sapiens; identical to SEQ ID NO: 838

SEQ ID NO: 844 - DNA, 171 bp, Homo sapiens; identical to SEQ ID NO: 839

SEQ ID NO: 845 - DNA, 201 bp, Homo sapiens; identical to SEQ ID NO: 840

SEQ ID NO: 846 - DNA, 201 bp, Homo sapiens; identical to SEQ ID NO: 841

SEQ ID NO: 847 - DNA, 120 bp, Homo sapiens
atccagggaatagtgacagytgcaacacagtgtgatgggctactgtgctctgggactctcacccagagcaggcaaaggcacaagccctttactactggagaggtggcatcaggccacgat

SEQ ID NO: 848 - DNA, 132 bp, Homo sapiens
atccagggaatagtgacagctgcaacacagtktgatgggctactgtgctctgggactctcacccagagcaggcaaaggcacaagccctttactactggagaggtggcatcaggccacgatttctgctggaaa

SEQ ID NO: 849 - DNA, 119 bp, Homo sapiens
atccagggaatagtgacasctgcaacacagtgtgatgggctactgtgctctgggactctcacccagagcaggcaaaggcacaagccctttactactggagaggtggcatcaggccacga

SEQ ID NO: 850 - DNA, 201 bp, Homo sapiens
tgtgctttgagaaggctctggaaaagaagccaaagaacccagaattcacctctggactggcaatagcaagctaccgtctggacaactggccaccatctcakaacgccattgaccctctgaggcaagccattcggctgaatcctgacaaccagtaccttaaagtcctcctggctctgaagcttcataagatgcgtgaagaag

SEQ ID NO: 851 - DNA, 201 bp, Homo sapiens
aaagcgattgaactgcttaaaaaggctttagaatacataccaaacaatgcctacctgcattgccaaattgggtgctgctatagggcaaaagtcttccaagyaatgaatctaagagagaatggaatgtatgggaaaagaaagttactggaactaataggacacgctgtggctcatctgaagaaagctgatgaggccaatgat

SEQ ID NO: 852 - DNA, 201 bp, Homo sapiens
aatcgtgaattcaaagccacaatgtgcaacctactggcctatctaaagcacctcaaagggcaaaacgaggcagccctggaatgcttacgtaaagctgaagmgttaatccagcaagagcatgctgaccaggcagaaatcagaagtctggtcacctggggaaactatgcctgggtctactatcacatgggccgactctcagac

SEQ ID NO: 853 - DNA, 137 bp, Homo sapiens
attggtggcagaagaggaagatttctgaagagtgcasctgcctgaaccgagccctgccgaacagctgagaattgcactgcaaccatgagtgagaacaataagaattccttggagagcagcctacggcaactaaaatg

SEQ ID NO: 854 - DNA, 201 bp, Homo sapiens
ttagaatacataccaaacaatgcctacctgcattgccaaattgggtgctgctatagggcaaaagtcttccaagtaatgaatctaagagagaatggaatgtrtgggaaaagaaagttactggaactaataggacacgctgtggctcatctgaagaaagctgatgaggccaatgataatctcttccgtgtctgttccattctt

SEQ ID NO: 855 - DNA, 201 bp, Homo sapiens
caggcagaaatcagaagtctggtcacctggggaaactatgcctgggtctactatcacatgggccgactctcagacgttcagatttatgtagacaaggtgaracatgtctgtgagaagttttccagtccctatagaattgagagtccagagcttgactgtgaggaagggtggacacggttaaagtgtggaggaaaccaaaat

SEQ ID NO: 856 - DNA, 201 bp, Homo sapiens
ctctgaagcttcataagatgcgtgaagaaggtgaagaggaaggtgaaggagagaagttagttgaagaagccttggagaaagccccaggtgtaacagatgtwcttcgcagtgcagccaagttttatcgaagaaaagatgagccagacaaagcgattgaactgcttaaaaaggctttagaatacataccaaacaatgcctacc

SEQ ID NO: 857 - DNA, 201 bp, Homo sapiens
gttcagatttatgtagacaaggtgaaacatgtctgtgagaagttttccagtccctatagaattgagagtccagagcttgactgtgaggaagggtggacacsgttaaagtgtggaggaaaccaaaatgaaagagcgaaggtgtgctttgagaaggctctggaaaagaagccaaagaacccagaattcacctctggactggca

SEQ ID NO: 858 - DNA, 201 bp, Homo sapiens
ctgtggctcatctgaagaaagctgatgaggccaatgataatctcttccgtgtctgttccattcttgccagcctccatgctctagcagatcagtatgaagamgcagagtattacttccaaaaggaattcagtaaagagcttactcctgtagcgaaacaactgctccatctgcggtatggcaactttcagctgtaccaaatga

SEQ ID NO: 859 - DNA, 201 bp, Homo sapiens
gggtaggtccacgggcttggtgatagaattatttctcgattgacttcttgagtgcaatttgaactgtaacatttgcttagtcacctttagtggagtaatcyactgggcttgtttctatatttatataaagcagccaaatccttcatgtaatattgaagtccatttttgcaatgttgttccatacttggagtcattttgcat

SEQ ID NO: 860 - DNA, 201 bp, Homo sapiens
gtccatttttgcaatgttgttccatacttggagtcattttgcatcccatagaggttagtcctgcatagccagtaatgtgctaagttcatccaaaagctggsggaccaaagtctaaatagggctcagtatcccccatcgcttatctctgcctccttcctcctccttcccagtctatcatcaaccttgagtattctacacaat

SEQ ID NO: 861 - DNA, 201 bp, Homo sapiens
tggcatgggttggtaaaggccttcagcgggatctgggtggtgaccgtggtctgaaagaaggctgggttgaactagtacagcttcaggacagtcaagctggyttctagatcacaggcattctccttggcctgtatctccacatagctccccagggaggccaggttctcagaattatacctgtggatattgttgagcaacttg

SEQ ID NO: 862 - DNA, 201 bp, Homo sapiens
gatctcccaggtacaaaatctgttggatcagctgcttttcttgatgcgcttggatgaccatgtgcttgcacagggtgaagctggtgtggcatgggttggtwaaggccttcagcgggatctgggtggtgaccgtggtctgaaagaaggctgggttgaactagtacagcttcaggacagtcaagctggcttctagatcacagg

SEQ ID NO: 863 - DNA, 201 bp, Homo sapiens
acattggtttgctaataaatttgattctaaggtggaccctatcttgattaaatgcttggcagaaaagcttgaagaacagcagagagactggatcactttgycctcagaaaagttatttatggatagaaatctcactaccacatcatgatagtaaaatcaggatggaaataagagggtgcctgataaatggagtcagtgtgg

SEQ ID NO: 864 - DNA, 201 bp, Homo sapiens
ggccctgttgatgacatccagttctctagacctctgcccaaaccagagcaatccctcctcaaatatgctaagcagaaatgcagacaatataagacacactmtatttatattttaggagtttacattaccttcccttctgtttggaaaccaacatctctcaaaattaggtatagttaacacagaataccccaaaataccacc

SEQ ID NO: 865 - DNA, 201 bp, Homo sapiens
ctccaaggaagcacccccccataacattcagatatttgttggcagtgcttattttgttttaagtcaagcatttgttaaatatattttcaacaactccatcrttcaagacttttttgcctggtctaaagacacatactctcctgatgagcacttttgggctaccttgattcgggttccaggaatacctggggagatttccag

SEQ ID NO: 866 - DNA, 201 bp, Homo sapiens
ttgccctcagaaaagttatttatggatagaaatctcactaccacatcatgatagtaaaatcaggatggaaataagagggtgcctgataaatggagtcagtrtggaattgaataccatactatgcccaatactgtttaaactcagtcctcccatattttaaaaggtgtccaaaattccatacacaagggaaagtgatctagc

SEQ ID NO: 867 - DNA, 201 bp, Homo sapiens
gttatttatggatagaaatctcactaccacatcatgatagtaaaatcaggatggaaataagagggtgcctgataaatggagtcagtgtggaattgaatacyatactatgcccaatactgtttaaactcagtcctcccatattttaaaaggtgtccaaaattccatacacaagggaaagtgatctagcctttgatgttatta

SEQ ID NO: 868 - DNA, 201 bp, Homo sapiens
caaaacagtatcatgaatggcctcctttttagttcaactgtttctttaaaatgcatttactgattaaaaataagaactgaccaatagctccaagtgtcacacaccagaacattaagcctaagtcctcaattcataagttatcattctagataagtttctttacaatggaatactttctatggaatcattataattctgttg

SEQ ID NO: 869 - DNA, 201 bp, Homo sapiens
aacagtatcatgaatggcctcctttttagttcaactgtttctttaaaatgcatttactgattaaaaataagaactgaccaatagctccaagtgtcacacaccagaacattaagcctaagtcctcaattcataagttatcattctagataagtttctttacaatggaatactttctatggaatcattataattctgttgtat

SEQ ID NO: 870 - DNA, 201 bp, Homo sapiens
acagtatcatgaatggcctcctttttagttcaactgtttctttaaaatgcatttactgattaaaaataagaactgaccaatagctccaagtgtcacacaccagaacattaagcctaagtcctcaattcataagttatcattctagataagtttctttacaatggaatactttctatggaatcattataattctgttgtatg

SEQ ID NO: 871 - DNA, 201 bp, Homo sapiens
cagtatcatgaatggcctcctttttagttcaactgtttctttaaaatgcatttactgattaaaaataagaactgaccaatagctccaagtgtcacacaccagaacattaagcctaagtcctcaattcataagttatcattctagataagtttctttacaatggaatactttctatggaatcattataattctgttgtatgg

SEQ ID NO: 872 - DNA, 201 bp, Homo sapiens
gaccaatagctccaagtgtcacacaccagaacattaagcctaagtcctcaattcataagttatcattctagataagtttctttacaatggaatactttctrtggaatcattataattctgttgtatggaactatcaagctaagagtcactaaactttcttcaaaaggttgtgtgaaatatgacagctttctaaattaattt

SEQ ID NO: 873 - DNA, 201 bp, Homo sapiens
cgaggaggtggccctgtattcccagcccctgtcgttggcagtggaggggccacatctggaaagctgctgctggaggcagatgagctgtgcgatgatggtgrggatgggaggggggcagtggttcctggggctgggctccggagacccacctacacaccccctagcatcatgccacagaaacactgggtatacgtgaagcga

SEQ ID NO: 874 - DNA, 201 bp, Homo sapiens
ttctcatcttcctcccaagaggcatttgcagcttctgcagtgggcagtggggagcgtcgaggaggtggccctgtattcccagcccctgtcgttggcagtgsaggggccacatctggaaagctgctgctggaggcagatgagctgtgcgatgatggtggggatgggaggggggcagtggttcctggggctgggctccggaga

SEQ ID NO: 875 - DNA, 201 bp, Homo sapiens
cgccaccgaggacactgtgagcgccggcaccgcctgggcggggtcggggccgtacctgggcctgggactcccacggggccatccttgccgtccaagagagrgtctcccggagtgggcgggggcagcggcgacgaagcgagtgcggccacgcccccgtccagcagacgtgtctggtccccacccagagtccacaaggtggag

SEQ ID NO: 876 - DNA, 201 bp, Homo sapiens
tcagcatggctgctgctgacattgtcaacttccttacagtggggtctgtgctccaaatgtggcacattgtggacaagtgcactgaactactccgagaaggscgggcctcagctaccaccaccatcactactgctgcagccacctctgtcactgtccctggtgctggggtgccatccgggagtgggggcactgtggcccctg

SEQ ID NO: 877 - DNA, 201 bp, Homo sapiens
tcctggggctgggctccggagacccacctacacaccccctagcatcatgccacagaaacactgggtatacgtgaagcgaggtggtaattgcccagcgccarcacccctggttccccaagacccagatctggaggaggaagaggaggaggaagatctggtgttgacctgtgaggatgatgaagatgaagaactagggggtag

SEQ ID NO: 878 - DNA, 201 bp, Homo sapiens
tggtgttgacctgtgaggatgatgaagatgaagaactagggggtagctccagggttccagtggggggagggcctgaggctaccctcagcataagtgatgtscgtaccctgagtgagcccccagacaagggggaggagcaggtcaacttctgtgagtcctccaatgactttggcccatatgagggtgggggtcctgtggcag

SEQ ID NO: 879 - DNA, 201 bp, Homo sapiens
tgcggccgtttgactgccccgtgtgcaacaaaaagttcaagatgaagcaccatctgactgagcacatgaagacgcacacaggtctcaagccctacgagtgyggagtctgcgccaagaagttcatgtggcgagacagcttcatgcgccaccgaggacactgtgagcgccggcaccgcctgggcggggtcggggccgtacctg

SEQ ID NO: 880 - DNA, 201 bp, Homo sapiens
tgtggacaagtgcactgaactactccgagaaggccgggcctcagctaccaccaccatcactactgctgcagccacctctgtcactgtccctggtgctgggstgccatccgggagtgggggcactgtggcccctgctaccatgggctctgcgcgctcccatgcctccagccgggccagtgagaatcaatctcccagcagcag

SEQ ID NO: 881 - DNA, 201 bp, Homo sapiens
ggcgctgtggcccccgggtgatctcccaccacacttactgtcttcctttatctctgtggacttgtatatattctggaaggggaaccacagtttcaccatcrcccgcccattctactactcaacccctcccccccaaggtatttccagaactaaacccttcctttccctctgatgggtacactgaagcccctgctccacaga

SEQ ID NO: 882 - DNA, 201 bp, Homo sapiens
ctgtgcctgaagtctgtgtttgtgttgtcgtggagacaaggcctttgagccccacccttgtcctagaacctaccccctctcaaggatgcgctctttatttytaccctgtctctccccgccacccccgacttcccgtggaaattcccaactcggttctcatggaggagtgggtggagacaaggagggagtaagtcgtaggag

SEQ ID NO: 883 - DNA, 201 bp, Homo sapiens
aagtctgtgtttgtgttgtcgtggagacaaggcctttgagccccacccttgtcctagaacctaccccctctcaaggatgcgctctttatttctaccctgtytctccccgccacccccgacttcccgtggaaattcccaactcggttctcatggaggagtgggtggagacaaggagggagtaagtcgtaggagtacaaggtt

SEQ ID NO: 884 - DNA, 199 bp, Homo sapiens
ccttgtcctagaacctaccccctctcaaggatgcgctctttatttctaccctgtctctccccgccacccccgacttcccgtggaaattcccaactcggttytcatggaggagtgggtggagacaaggagggagtaagtcgtaggagtacaaggtttttattttttttaacagtgattaaaatatttattggtcatttac

SEQ ID NO: 885 - DNA, 201 bp, Homo sapiens
tcatctcaagctggttaaccctctgcgacatggcatcatcgtggactgggatacagtgcaggatatctgggaatatctcttccgacaagagatgaagatcsccccggaggagcatgcggtcttggtttcagacccgccactgagcccacacaccaacagagagaaatatgctgaaatgctgtttgaagccttcaacacccc

SEQ ID NO: 886 - DNA, 201 bp, Homo sapiens
actgcctctttaagggatggcccggcgaagcgggccgtgtgggtccgccatacgagttcagagccacaagaacctactgaatcaaaggcagccaaggagakgcccaagcaggaggtgaccaaagcagtggtcgtggacctgggcactggctactgtaaatgtggctttgccggcctgccaagacccacccacaagatctca

SEQ ID NO: 887 - DNA, 201 bp, Homo sapiens
gggatacagtgcaggatatctgggaatatctcttccgacaagagatgaagatcgccccggaggagcatgcggtcttggtttcagacccgccactgagcccwcacaccaacagagagaaatatgctgaaatgctgtttgaagccttcaacacccctgcaatgcacatcgcctaccagtcgcgcctgtccatgtactcctatg

SEQ ID NO: 888 - DNA, 201 bp, Homo sapiens
tacatggagaccgccaagactggggataatcgcaaggagacattcgtggggcaggaactcaacaacacaaacgttcatctcaagctggttaaccctctgcracatggcatcatcgtggactgggatacagtgcaggatatctgggaatatctcttccgacaagagatgaagatcgccccggaggagcatgcggtcttggtt

SEQ ID NO: 889 - DNA, 201 bp, Homo sapiens
tgctgtttgaagccttcaacacccctgcaatgcacatcgcctaccagtcgcgcctgtccatgtactcctatggaaggacctccggcctggtggtggaggtrggccatggcgtgtcctacgtggtccccatctacgagggttatcctttgcccagcatcaccggaaggctggactacgcgggctctgacctgacagcctacc

SEQ ID NO: 890 - DNA, 201 bp, Homo sapiens
gaaggagattcagctgtgccaggaacggttcctctgctcggagatgttcttcaagccatctctcatcaagtccatgcagctgggcctccacacccaaaccrtgtcctgccttaacaagtgtgacatcgccctcaaacgggacctcatggggaacatcctgctctgcgggggcagcacgatgctcagtggcttccctaaccg

SEQ ID NO: 891 - DNA, 201 bp, Homo sapiens
ccatcctggcctcacttcagggtttccaaccattgtgggtccaccgctttgagtacgaggaacacgggcctttcttcctctacagaaggtgcttctgaacrgcgacgaggatggacactgcactggcagtgcctaccctcgacagggtgagcgcactcctacacacagggggtggagccggcgcttattcctgtagcatta

SEQ ID NO: 892 - DNA, 201 bp, Homo sapiens
atctcaacaacggtgggcaagccctacatggagaccgccaagactggggataatcgcaaggagacattcgtggggcaggaactcaacaacacaaacgttcrtctcaagctggttaaccctctgcgacatggcatcatcgtggactgggatacagtgcaggatatctgggaatatctcttccgacaagagatgaagatcgcc

SEQ ID NO: 893 - DNA, 201 bp, Homo sapiens
tcctggcctcacttcagggtttccaaccattgtgggtccaccgctttgagtacgaggaacacgggcctttcttcctctacagaaggtgcttctgaacggcracgaggatggacactgcactggcagtgcctaccctcgacagggtgagcgcactcctacacacagggggtggagccggcgcttattcctgtagcattaaac

SEQ ID NO: 894 - DNA, 201 bp, Homo sapiens
ttcagaaggagaccacgtcacttcagtaaatgaatatatgctagaaagcgatttttcaacaactacagacaacaaactgacagctaaaaaggaaaaactcmaatcagaagatgatatggggaccgactttattaagtcaacaactcacctacagaaagaaattacctctctgactggcactacaaactccataacaagaga

SEQ ID NO: 895 - DNA, 201 bp, Homo sapiens
tatcactgtgtttgaactcactacctctgctgaaaaagacaaagataaacgggaagatactctgctaactgatgaagaaactaccgagggagccagtattkggatggagagagatactgcaaatgaagcagagacccattctgttttgcttactgctgttgaatccagatatgacttcgttgtccctgcatcaatagctac

SEQ ID NO: 896 - DNA, 201 bp, Homo sapiens
acctctgtattagataccccagactataaggaagacacctccacaactgaaacggatatctttgaactactgaaagaagaacccgatgagttcatgatttraaagcaacaaaagggataccatgtagaattgtgcaatagtctagccagctagccttaacatctaagaaatttttccaacaagcaaaaacctttagaaatg

SEQ ID NO: 897 - DNA, 201 bp, Homo sapiens
gcctttccacgtaaaaaggatgaagctgatatgagcaattataattcctccatcaaatccaatgtccctgctgatgaggctgtccaggtcactgattccaytattcctgaggctgaaatccctcctgctcctgaagaaagcttcactactattccagacataactgcccttgaagaagagaaaataaccgaaattgaccta

SEQ ID NO: 898 - DNA, 201 bp, Homo sapiens
cttcgccccatggctgaagatggtttgcccaaaatttattctcatcctccaacagaaagcagtaaaacaccaactgcagcaaccattttctttggggctgmcaatgctattcccaaatcagaaacaactattacttcagaaggagaccacgtcacttcagtaaatgaatatatgctagaaagcgatttttcaacaactaca

SEQ ID NO: 899 - DNA, 201 bp, Homo sapiens
tttgcccaaaatttattctcatcctccaacagaaagcagtaaaacaccaactgcagcaaccattttctttggggctgacaatgctattcccaaatcagaamcaactattacttcagaaggagaccacgtcacttcagtaaatgaatatatgctagaaagcgatttttcaacaactacagacaacaaactgacagctaaaaa

SEQ ID NO: 900 - DNA, 201 bp, Homo sapiens
ttttcaacaactacagacaacaaactgacagctaaaaaggaaaaactcaaatcagaagatgatatggggaccgactttattaagtcaacaactcacctacrgaaagaaattacctctctgactggcactacaaactccataacaagagactctattaccgaacatttcatgccagtgaaaattgggaatatttcatcacca

SEQ ID NO: 901 - DNA, 201 bp, Homo sapiens
aagaagagaaaataaccgaaattgacctaagtgttttagaagatgacaccagtgctgtggctacattaactgactctgatgagaagtttatcactgtgttygaactcactacctctgctgaaaaagacaaagataaacgggaagatactctgctaactgatgaagaaactaccgagggagccagtatttggatggagagag

SEQ ID NO: 902 - DNA, 201 bp, Homo sapiens
ccagactataaggaagacacctccacaactgaaacggatatctttgaactactgaaagaagaacccgatgagttcatgatttaaaagcaacaaaagggatrccatgtagaattgtgcaatagtctagccagctagccttaacatctaagaaatttttccaacaagcaaaaacctttagaaatgaaagaatgtgggcattta

SEQ ID NO: 903 - DNA, 201 bp, Homo sapiens; identical to SEQ ID NO: 894

SEQ ID NO: 904 - DNA, 201 bp, Homo sapiens; identical to SEQ ID NO: 895

SEQ ID NO: 905 - DNA, 201 bp, Homo sapiens; identical to SEQ ID NO: 896

SEQ ID NO: 906 - DNA, 201 bp, Homo sapiens; identical to SEQ ID NO: 897

SEQ ID NO: 907 - DNA, 201 bp, Homo sapiens; identical to SEQ ID NO: 898

SEQ ID NO: 908 - DNA, 201 bp, Homo sapiens; identical to SEQ ID NO: 899

SEQ ID NO: 909 - DNA, 201 bp, Homo sapiens; identical to SEQ ID NO: 900

SEQ ID NO: 910 - DNA, 201 bp, Homo sapiens; identical to SEQ ID NO: 901

SEQ ID NO: 911 - DNA, 201 bp, Homo sapiens; identical to SEQ ID NO: 902

SEQ ID NO: 912 - DNA, 201 bp, Homo sapiens
tccagcgcatgaagaaggtgggcacagctcagaccaagatccagctcctgctgctcggggacctgttggaacagctcgaccatggccgtgctgagctggaygccctgctccggtcgccagacccacggcccttcctggccgactgggcgctggtggagcggcggctggcggacgtgtcggccgtcatggacagcttcctga

SEQ ID NO: 913 - DNA, 201 bp, Homo sapiens
accatggccgtgctgagctggatgccctgctccggtcgccagacccacggcccttcctggccgactgggcgctggtggagcggcggctggcggacgtgtcrgccgtcatggacagcttcctgaccatgatggtgccggggcggctacacgtcaagcaccgcctggtgtctgatgtcagtgccaccaagatcccgcacatct

SEQ ID NO: 914 - DNA, 201 bp, Homo sapiens
gtccgcacctgctcaagcgccaccacgcccgcatgcagctgctgcgtaagtgctcctactacatcgaggtcctgcccaagcacctggccctgggcgaccaraacccgctggtgctgcctagcgccttgttccagctcatcgacccctggaagttccagcgcatgaagaaggtgggcacagctcagaccaagatccagctcc

SEQ ID NO: 915 - DNA, 201 bp, Homo sapiens
gcaatgccctgcgtgagttcctgacctcggacctgagtccgcacctgctcaagcgccaccacgcccgcatgcagctgctgcgtaagtgctcctactacatygaggtcctgcccaagcacctggccctgggcgaccagaacccgctggtgctgcctagcgccttgttccagctcatcgacccctggaagttccagcgcatga

SEQ ID NO: 916 - DNA, 201 bp, Homo sapiens
aggaggaggcagatgaccagcagctgctggaaccagaggcgtggaagacctacaccgagcgccgcaatgccctgcgtgagttcctgacctcggacctgagyccgcacctgctcaagcgccaccacgcccgcatgcagctgctgcgtaagtgctcctactacatcgaggtcctgcccaagcacctggccctgggcgaccaga

SEQ ID NO: 917 - DNA, 197 bp, Homo sapiens
ttccactcccacccgcccagctcgcgccacatacagtccctcaacgcgctcctgccgcgccgccccctccagacagcagcgttccggatcctagacrctttttgacggctggtcctccccagaaaatgcgccgtgtgagcccaaacatggtggggtttacgctggaccccgagcttgcaatctgtgcttgacaaaac

SEQ ID NO: 918 - DNA, 201 bp, Homo sapiens
actgcgacatccccggccctccggcctcagacgtgagagccagggccaagtgggaggcttggagcgcgaaaaaaggggcgtccaagatggacgccatgagrggctacgcggccaaagtggaggagctgacgaagaaggaagtggggggcgtggagcgcgaacaaaggggcgtgcaagatggacgccatgaggggctacgcg

SEQ ID NO: 919 - DNA, 201 bp, Homo sapiens
acggcttgtacaaacaggccacccagggcgactgcgacatccccggccctccggcctcagacgtgagagccagggccaagtgggaggcttggagcgcgaamaaaggggcgtccaagatggacgccatgaggggctacgcggccaaagtggaggagctgacgaagaaggaagtggggggcgtggagcgcgaacaaaggggcg

SEQ ID NO: 920 - DNA, 201 bp, Homo sapiens
aaggggcgtccaagatggacgccatgaggggctacgcggccaaagtggaggagctgacgaagaaggaagtggggggcgtggagcgcgaacaaaggggcgtscaagatggacgccatgaggggctacgcggccaaagtggaggagctgacgaagaaggaagtggggggcgtggagcgcgaacaaaggggcgtccaagatgga

SEQ ID NO: 921 - DNA, 201 bp, Homo sapiens
gtgggaggcttggagcgcgaaaaaaggggcgtccaagatggacgccatgaggggctacgcggccaaagtggaggagctgacgaagaaggaagtggggggcktggagcgcgaacaaaggggcgtgcaagatggacgccatgaggggctacgcggccaaagtggaggagctgacgaagaaggaagtggggggcgtggagcgcg

SEQ ID NO: 922 - DNA, 201 bp, Homo sapiens
ccaagtgggaggcttggagcgcgaaaaaaggggcgtccaagatggacgccatgaggggctacgcggccaaagtggaggagctgacgaagaaggaagtgggrggcgtggagcgcgaacaaaggggcgtgcaagatggacgccatgaggggctacgcggccaaagtggaggagctgacgaagaaggaagtggggggcgtggag

SEQ ID NO: 923 - DNA, 145 bp, Homo sapiens
ggaagtggggggcgtggagcgcgaacaaaggggcgtgcaagatggacgccatgaggggctacgcggccaaagtggaggagctgacgaagaaggaagtgggrggcgtggagcgcgaacaaaggggcgtccaagatggacgccatga

SEQ ID NO: 924 - DNA, 118 bp, Homo sapiens
aaggggcgtgcaagatggacgccatgaggggctacgcggccaaagtggaggagctgacgaagaaggaagtggggggcgtggagcgcgaacaaaggggcgtscaagatggacgccatga

SEQ ID NO: 925 - DNA, 201 bp, Homo sapiens
atggacgccatgaggggctacgcggccaaagtggaggagctgacgaagaaggaagggcgtccaagatggacgccatgaggggctacgcggccagagtgagkagatgaggaagaaggaggctggctgagggctcctcgggaatggaaagggcttcttagaccttgatggctgaaatgtcctgaaactgtcgcaagcttagcc

SEQ ID NO: 926 - DNA, 201 bp, Homo sapiens
ccggcggctgcgcggggctaacgccccctcccctccgagaactcgaacgcggcgcgggacgcacggcacgatgggagacgcaggagccacggcggccgcgsttaggcctgctcacaacctccgcccggccccgcccacagcctccgccgcgcacgcgcagtcctcacgaacgagcgcgccaagcgcacagcgccgccttcc

SEQ ID NO: 927 - DNA, 201 bp, Homo sapiens
cgtgcaagatggacgccatgaggggctacgcggccaaagtggaggagctgacgaagaaggaagggcgtccaagatggacgccatgaggggctacgcggccrgagtgaggagatgaggaagaaggaggctggctgagggctcctcgggaatggaaagggcttcttagaccttgatggctgaaatgtcctgaaactgtcgcaa

SEQ ID NO: 928 - DNA, 201 bp, Homo sapiens
cacggcacgatgggagacgcaggagccacggcggccgcgcttaggcctgctcacaacctccgcccggccccgcccacagcctccgccgcgcacgcgcagtyctcacgaacgagcgcgccaagcgcacagcgccgccttccggcagagccctcccaccagccctcaggtacccggacgtcgctcactagacccctccgcacc

SEQ ID NO: 929 - DNA, 201 bp, Homo sapiens
acgatgggagacgcaggagccacggcggccgcgcttaggcctgctcacaacctccgcccggccccgcccacagcctccgccgcgcacgcgcagtcctcackaacgagcgcgccaagcgcacagcgccgccttccggcagagccctcccaccagccctcaggtacccggacgtcgctcactagacccctccgcaccgtcccc

SEQ ID NO: 930 - DNA, 201 bp, Homo sapiens
cgggacccggaccaccccccgccaaggccaccccgggacccctagacccgccccgacgcgggggacgtttcggtccgggcccgcgcgagcgtgcgcgacargaggagacgcgacggggcagcaccgctctggtggcgcattgctggacgcagcccggggccggggagccgcggcacccacctaggtccatggcggcgacgc

SEQ ID NO: 931 - DNA, 201 bp, Homo sapiens
acgcgggggacgtttcggtccgggcccgcgcgagcgtgcgcgacaggaggagacgcgacggggcagcaccgctctggtggcgcattgctggacgcagccckgggccggggagccgcggcacccacctaggtccatggcggcgacgccggcggctgcgcggggctaacgccccctcccctccgagaactcgaacgcggcgcg

SEQ ID NO: 932 - DNA, 201 bp, Homo sapiens
ctccgcccggccccgcccacagcctccgccgcgcacgcgcagtcctcacgaacgagcgcgccaagcgcacagcgccgccttccggcagagccctcccaccrgccctcaggtacccggacgtcgctcactagacccctccgcaccgtcccctgcccggcccctcttccggggtcccagcgggtcgggctcatgattccccgg

SEQ ID NO: 933 - DNA, 201 bp, Homo sapiens
ctggtggcgcattgctggacgcagcccggggccggggagccgcggcacccacctaggtccatggcggcgacgccggcggctgcgcggggctaacgcccccycccctccgagaactcgaacgcggcgcgggacgcacggcacgatgggagacgcaggagccacggcggccgcgcttaggcctgctcacaacctccgcccggc

SEQ ID NO: 934 - DNA, 201 bp, Homo sapiens
aaggggcgtccaagatggacgccatgaggggctacgcggccaaagtggaggagctgacgaagaaggaagtggggggcgtggagcgcgaacaaaggggcgtscaagatggacgccatgaggggctacgcggccaaagtggaggagctgacgaagaaggaagggcgtccaagatggacgccatgaggggctacgcggccagag

SEQ ID NO: 935 - DNA, 201 bp, Homo sapiens
ttgatggctgaaatgtcctgaaactgtcgcaagcttagccgagacatcaataaatcacttaaactgcatgagagtgactgctgttggaaaggagaaactcrgtgactgagtgctggggaggcgtccaaatacacagactaactttttgtatggttttgggtggagttcccagctctcctattacaagagcgtatgtaggta

SEQ ID NO: 936 - DNA, 201 bp, Homo sapiens
tgctgtggaaatgcccaagatctgagggcaggagaccattctccagtgacagcctcttgggaggttgaggccccagccccttatctcttcaaggctgattyactaataccccagcaccacagaggggagagggactctgtcctcctaaacactaaagtcaagtccaaaagcccccactggaacacagggcctacttgatgc

SEQ ID NO: 937 - DNA, 201 bp, Homo sapiens
cccccttggcttccttggccccagttgctgattcctccacgagggtggactctcccagccatggcctggtgaccagctccctctgcatcccttctccagcycggctgtcccaaaccccccattcacagcctcctcggcctggtacttgcaagacaagtgtggccacacaatgcgatccagaagagatcatcgtgctctcag

SEQ ID NO: 938 - DNA, 201 bp, Homo sapiens
caggcatggtctcttctacttccttcaatggaggcgtctctcctcacaactggggagattctggtcccccctgcaaaaaatctcggaaggagaagaagcaracaggatcagggccattaggaaacagctatgtggaaaggcaaaggtcagtgcatgagaagaatgggaaaaagatatgtaccctgcccagcccaccttccc

SEQ ID NO: 939 - DNA, 201 bp, Homo sapiens
caggcgttgaccctgcactatcagatcctgtgttggcccggcgccttcgggaaaaccggagtttggccatgagtcggctggatgaggtcatctccaaataygcaatgttgcaagacaaaagtgaggagggcgagagaaaaaagagaagagctcggctccaaggcacctcttcccactctgcagacacccccgaagcctcct

SEQ ID NO: 940 - DNA, 201 bp, Homo sapiens
agatgactataggccaggcgttgaccctgcactatcagatcctgtgttggcccggcgccttcgggaaaaccggagtttggccatgagtcggctggatgagrtcatctccaaatatgcaatgttgcaagacaaaagtgaggagggcgagagaaaaaagagaagagctcggctccaaggcacctcttcccactctgcagacac

SEQ ID NO: 941 - DNA, 201 bp, Homo sapiens
ctgattcctccacgagggtggactctcccagccatggcctggtgaccagctccctctgcatcccttctccagcccggctgtcccaaaccccccattcacakcctcctcggcctggtacttgcaagacaagtgtggccacacaatgcgatccagaagagatcatcgtgctctcagactctgattagctgcctccccttctcc

SEQ ID NO: 942 - DNA, 201 bp, Homo sapiens
ccctgcaaaaaatctcggaaggagaagaagcaaacaggatcagggccattaggaaacagctatgtggaaaggcaaaggtcagtgcatgagaagaatgggaraaagatatgtaccctgcccagcccaccttcccccttggcttccttggccccagttgctgattcctccacgagggtggactctcccagccatggcctggtg

SEQ ID NO: 943 - DNA, 201 bp, Homo sapiens
agttccttgaactttgtaagatgcagacagcagaccaccctgaggtggtcccattcctctataaccggcagcaacgtgcccactctctgtttttggcctcrgcggagttctgcaacatcctctctagggtcctgtctcgggcccggagccggccagccaagctctatgtctacatcaatgagctctgcactgttctcaagg

SEQ ID NO: 944 - DNA, 201 bp, Homo sapiens
gtacttgcaagacaagtgtggccacacaatgcgatccagaagagatcatcgtgctctcagactctgattagctgcctccccttctccctgcctccagaatkttctgggataacatttggaggaaggtgggaagcagatgactgaggaagggatggactaagctaatccccttttggtggtgtttctttaaaaaaaaaaaaa

SEQ ID NO: 945 - DNA, 201 bp, Homo sapiens
cttgcaagacaagtgtggccacacaatgcgatccagaagagatcatcgtgctctcagactctgattagctgcctccccttctccctgcctccagaatgttytgggataacatttggaggaaggtgggaagcagatgactgaggaagggatggactaagctaatccccttttggtggtgtttctttaaaaaaaaaaaaaagc

SEQ ID NO: 946 - DNA, 201 bp, Homo sapiens; identical to SEQ ID NO: 937

SEQ ID NO: 947 - DNA, 201 bp, Homo sapiens; identical to SEQ ID NO: 938

SEQ ID NO: 948 - DNA, 201 bp, Homo sapiens; identical to SEQ ID NO: 939

SEQ ID NO: 949 - DNA, 201 bp, Homo sapiens; identical to SEQ ID NO: 940

SEQ ID NO: 950 - DNA, 201 bp, Homo sapiens
gtgggaaggaaggcggagggaaccatgcgaggttctgagaattgcggcgagggtcgcctcgagagacggtttctgagcaggaattctgaaatccccaccayttcctccctccgggggatttgatcccctatggccaccgctaacagcatcatcgtgctggatgatgatgacgaagatgaagcagctgctcagccagggccc

SEQ ID NO: 951 - DNA, 201 bp, Homo sapiens; identical to SEQ ID NO: 941

SEQ ID NO: 952 - DNA, 201 bp, Homo sapiens; identical to SEQ ID NO: 942

SEQ ID NO: 953 - DNA, 201 bp, Homo sapiens; identical to SEQ ID NO: 943

SEQ ID NO: 954 - DNA, 201 bp, Homo sapiens; identical to SEQ ID NO: 944

SEQ ID NO: 955 - DNA, 201 bp, Homo sapiens; identical to SEQ ID NO: 945

SEQ ID NO: 956 - DNA, 201 bp, Homo sapiens
ggtcccccaggcaccttcacctaaccagagcggggatttccaccgcccctcatgccgccctttggaggaaagtgaaagtgaaaggaggaagaggaggcttmatggctgaggaggtcgcagcgccatgaagtccctgtctctgctcctcgctgtggctttgggcctggcgaccgccgtctcagcaggacccgcggtgatcga

SEQ ID NO: 957 - DNA, 201 bp, Homo sapiens
cccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatg

SEQ ID NO: 958 - DNA, 201 bp, Homo sapiens
gcccgcgggccctggatggggcttggctgatggtcagcatatccagcccagtcctcagcctctccagcctcttgcgaccacagccagagcctcagcaggascctgttctcatcaccatggcaacagtggtactgactgtcctcacccacacccctgcccctcgagtgagactgggacaagatgctctgctggacttgagct

SEQ ID NO: 959 - DNA, 201 bp, Homo sapiens
tactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctga

SEQ ID NO: 960 - DNA, 201 bp, Homo sapiens
tgcccgcgggccctggatggggcttggctgatggtcagcatatccagcccagtcctcagcctctccagcctcttgcgaccacagccagagcctcagcaggmgcctgttctcatcaccatggcaacagtggtactgactgtcctcacccacacccctgcccctcgagtgagactgggacaagatgctctgctggacttgagc

SEQ ID NO: 961 - DNA, 201 bp, Homo sapiens
cggtcccccaggcaccttcacctaaccagagcggggatttccaccgcccctcatgccgccctttggaggaaagtgaaagtgaaaggaggaagaggaggctwcatggctgaggaggtcgcagcgccatgaagtccctgtctctgctcctcgctgtggctttgggcctggcgaccgccgtctcagcaggacccgcggtgatcg

SEQ ID NO: 962 - DNA, 201 bp, Homo sapiens
agcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtcccccaggcaccttcacctaaccagagcggggatttcc

SEQ ID NO: 963 - DNA, 201 bp, Homo sapiens
cagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacaaaccccccaaa

SEQ ID NO: 964 - DNA, 201 bp, Homo sapiens
acccttgcacgggccgccccaggggaggcacccccggaattgctctgccttgtgtcccacttctacccttctgggggcctggaggtggagtgggaactccrgggtggcccagggggccgctctcagaaggccgaggggcagaggtggctctcggccctgcgccaccattccgatggctctgtcagcctctctgggactaca

SEQ ID NO: 965 - DNA, 201 bp, Homo sapiens
gggtagtccaggagggcgcggtaaggctggggtgtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggcttcatggctg

SEQ ID NO: 966 - DNA, 201 bp, Homo sapiens
tctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctattcctttcctccaatgaacc

SEQ ID NO: 967 - DNA, 201 bp, Homo sapiens
cagacgaggtcggcctcgtcattccccgcagaccgccgcgcgtccctcttgtgcggttcaccacagttgtatttaagtgatcgtgtgagtcgtcgttaaaygcctgtctccccgcggatcatgggctcctcgaggacagggactggcctgtctgtccactgctgtaaccccgcgccggcatagggacctaaggcccactgg

SEQ ID NO: 968 - DNA, 170 bp, Homo sapiens
ccctcttgtgcggttcaccacagttgtatttaagtgatcgtgtgagtcgtcgttaaatgcctgtctccccgcggatcatgggctcctcgaggacagggacyggcctgtctgtccactgctgtaaccccgcgccggcatagggacctaaggcccactggagggcgctcatc

SEQ ID NO: 969 - DNA, 201 bp, Homo sapiens; identical to SEQ ID NO: 956

SEQ ID NO: 970 - DNA, 201 bp, Homo sapiens; identical to SEQ ID NO: 961

SEQ ID NO: 971 - DNA, 201 bp, Homo sapiens; identical to SEQ ID NO: 962

SEQ ID NO: 972 - DNA, 201 bp, Homo sapiens; identical to SEQ ID NO: 965

SEQ ID NO: 973 - DNA, 201 bp, Homo sapiens; identical to SEQ ID NO: 966

SEQ ID NO: 974 - DNA, 201 bp, Homo sapiens; identical to SEQ ID NO: 967

SEQ ID NO: 975 - DNA, 170 bp, Homo sapiens; identical to SEQ ID NO: 968

SEQ ID NO: 976 - DNA, 201 bp, Homo sapiens; identical to SEQ ID NO: 956

SEQ ID NO: 977 - DNA, 201 bp, Homo sapiens; identical to SEQ ID NO: 957

SEQ ID NO: 978 - DNA, 201 bp, Homo sapiens; identical to SEQ ID NO: 958

SEQ ID NO: 979 - DNA, 201 bp, Homo sapiens; identical to SEQ ID NO: 959

SEQ ID NO: 980 - DNA, 201 bp, Homo sapiens; identical to SEQ ID NO: 960

SEQ ID NO: 981 - DNA, 201 bp, Homo sapiens; identical to SEQ ID NO: 961

SEQ ID NO: 982 - DNA, 201 bp, Homo sapiens; identical to SEQ ID NO: 962

SEQ ID NO: 983 - DNA, 201 bp, Homo sapiens; identical to SEQ ID NO: 963

SEQ ID NO: 984 - DNA, 201 bp, Homo sapiens
acccttgcacgggccgccccaggggaggcacccccggaattgctctgccttgtgtcccacttctacccttctgggggcctggaggtggagtgggaactccrgggtggcccagggggccgctctcagaaggccgaggggcagaggtggctctcggccctgcgccaccattccgatggctctgtcagcctctctgggcacttg

SEQ ID NO: 985 - DNA, 201 bp, Homo sapiens; identical to SEQ ID NO: 965

SEQ ID NO: 986 - DNA, 201 bp, Homo sapiens
agaggtggctctcggccctgcgccaccattccgatggctctgtcagcctctctgggcacttgcagccgcccccagtcaccactgagcagcatggggcacgstatgcctgtcgaattcaccatcccagcctgcctgcctcggggcgcagcgctgaggtcaccctggaggtagcaggtaagagctgggagctctgcggaatct

SEQ ID NO: 987 - DNA, 201 bp, Homo sapiens
ctgggagctctgcggaatctgagccagcacccaggaagacaggagctcactctcaccccttctgcctgccaggtctttcagggccctcccttgaggacagygtaggccttttcctgtctgcctttcttctgcttgggctcttcaaggcactgggctgggctggtaagtgtcagccctaccctgaccatgacctgaggttgg

SEQ ID NO: 988 - DNA, 201 bp, Homo sapiens
gcactatatcctaactgtaggactctttgagcatgctacttaatctatatgtttccttgggtgtagggattttaaaaagttacttaggcagtgctgtccartagaaagataatgcaagccacatatgtaaatttaaatactctagtactcacattaaaaaaataagcagaaacaggtaaaattaacttaataatatacctt

SEQ ID NO: 989 - DNA, 201 bp, Homo sapiens
aaaataagcagaaacaggtaaaattaacttaataatataccttatttaatctaataattctggtcccttatctgaaatgcttgggtcagaagtgtttttgkatgttggattttttcagactttggaatatttgcatatatttaatatctttgggatcagacccaaatctaaacacagaaatcatttatgtttcctatacac

SEQ ID NO: 990 - DNA, 199 bp, Homo sapiens
atgttggattttttcagactttggaatatttgcatatatttaatatctttgggatcagacccaaatctaaacacagaaatcatttatgtttcctatacacsttatacacatggcctgaagatttttttccttctctttttttctgagatcacaccattgcactccagcctgggtgacaaaaggaaaacttcgtctcaac

SEQ ID NO: 991 - DNA, 201 bp, Homo sapiens; identical to SEQ ID NO: 956

SEQ ID NO: 992 - DNA, 201 bp, Homo sapiens; identical to SEQ ID NO: 957

SEQ ID NO: 993 - DNA, 201 bp, Homo sapiens; identical to SEQ ID NO: 958

SEQ ID NO: 994 - DNA, 201 bp, Homo sapiens; identical to SEQ ID NO: 959

SEQ ID NO: 995 - DNA, 201 bp, Homo sapiens; identical to SEQ ID NO: 960

SEQ ID NO: 996 - DNA, 201 bp, Homo sapiens; identical to SEQ ID NO: 961

SEQ ID NO: 997 - DNA, 201 bp, Homo sapiens; identical to SEQ ID NO: 962

SEQ ID NO: 998 - DNA, 201 bp, Homo sapiens; identical to SEQ ID NO: 963

SEQ ID NO: 999 - DNA, 201 bp, Homo sapiens; identical to SEQ ID NO: 984

SEQ ID NO: 1000 - DNA, 201 bp, Homo sapiens; identical to SEQ ID NO: 965

SEQ ID NO: 1001 - DNA, 201 bp, Homo sapiens
agaggtggctctcggccctgcgccaccattccgatggctctgtcagcctctctgggcacttgcagccgcccccagtcaccactgagcagcatggggcacgstatgcctgtcgaattcaccatcccagcctgcctgcctcggggcgcagcgctgaggtcaccctggaggtagcaggtctttcagggccctcccttgaggaca

SEQ ID NO: 1002 - DNA, 201 bp, Homo sapiens
atgcctgtcgaattcaccatcccagcctgcctgcctcggggcgcagcgctgaggtcaccctggaggtagcaggtctttcagggccctcccttgaggacagygtaggccttttcctgtctgcctttcttctgcttgggctcttcaaggcactgggctgggctgctgtctacctgtccacctgcaaggattcaaagaagaaag

SEQ ID NO: 1003 - DNA, 201 bp, Homo sapiens
aggccttttcctgtctgcctttcttctgcttgggctcttcaaggcactgggctgggctgctgtctacctgtccacctgcaaggattcaaagaagaaagcakagtgagggcactcactgccatcctgtggaagccaccatcatctctggcccaagcttctgtagtagctccctaaaataataccctatcatctgctcctaat

SEQ ID NO: 1004 - DNA, 201 bp, Homo sapiens
caatctctctccactgagtggctggaatgcttttttttttttctttcacttatataagggataatttttcttttttttttttttttgagacggagtctcamtcttccgcccaggctgcagtgcagtggcatgatcttggcttactgcaacctccgcctcctgggttcaagcaattctgtggcttcagcctccggagtagct

SEQ ID NO: 1005 - DNA, 201 bp, Homo sapiens
tctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctcagaccgccgcgcgtccctct

SEQ ID NO: 1006 - DNA, 201 bp, Homo sapiens; identical to SEQ ID NO: 956

SEQ ID NO: 1007 - DNA, 201 bp, Homo sapiens; identical to SEQ ID NO: 958

SEQ ID NO: 1008 - DNA, 201 bp, Homo sapiens; identical to SEQ ID NO: 959

SEQ ID NO: 1009 - DNA, 201 bp, Homo sapiens; identical to SEQ ID NO: 960

SEQ ID NO: 1010 - DNA, 201 bp, Homo sapiens; identical to SEQ ID NO: 961

SEQ ID NO: 1011 - DNA, 201 bp, Homo sapiens; identical to SEQ ID NO: 962

SEQ ID NO: 1012 - DNA, 201 bp, Homo sapiens
cagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacagtgagttgggg

SEQ ID NO: 1013 - DNA, 201 bp, Homo sapiens; identical to SEQ ID NO: 965

SEQ ID NO: 1014 - DNA, 201 bp, Homo sapiens
cctgccatacctgcaaggacaggtcaccctggagcttgctgtgtacagtgagttgggggacagaggtctccaggggtagagggtgggcactggattgtggkgaccgtaatagggggagggatgatggataagagggtgcctgggcaagtaagtagagatagaaagaggttcctgggagttagaggggtaatgggaggctag

SEQ ID NO: 1015 - DNA, 201 bp, Homo sapiens
ctgccatacctgcaaggacaggtcaccctggagcttgctgtgtacagtgagttgggggacagaggtctccaggggtagagggtgggcactggattgtgggkaccgtaatagggggagggatgatggataagagggtgcctgggcaagtaagtagagatagaaagaggttcctgggagttagaggggtaatgggaggctaga

SEQ ID NO: 1016 - DNA, 201 bp, Homo sapiens
ttgctgtgtacagtgagttgggggacagaggtctccaggggtagagggtgggcactggattgtggggaccgtaatagggggagggatgatggataagaggrtgcctgggcaagtaagtagagatagaaagaggttcctgggagttagaggggtaatgggaggctagaagtttcctggaaatttgaggggctttgacatggg

SEQ ID NO: 1017 - DNA, 201 bp, Homo sapiens
gcactggattgtggggaccgtaatagggggagggatgatggataagagggtgcctgggcaagtaagtagagatagaaagaggttcctgggagttagagggrtaatgggaggctagaagtttcctggaaatttgaggggctttgacatgggtatttctgtgacgcaccaatggagagacagtgggttccctatttcaggaga

SEQ ID NO: 1018 - DNA, 201 bp, Homo sapiens
ctgggagttagaggggtaatgggaggctagaagtttcctggaaatttgaggggctttgacatgggtatttctgtgacgcaccaatggagagacagtgggtwccctatttcaggagaagaaacctaaccttctttagttctgaggaagccagcaggcaaactgagggtctcttagggaggacagtatggactgatttcccta

SEQ ID NO: 1019 - DNA, 201 bp, Homo sapiens
tatttctgtgacgcaccaatggagagacagtgggttccctatttcaggagaagaaacctaaccttctttagttctgaggaagccagcaggcaaactgaggrtctcttagggaggacagtatggactgatttccctatgctcatttcgtcctctttccccagaaccccccaaagtgtccctgatgccagcaacccttgcacg

SEQ ID NO: 1020 - DNA, 201 bp, Homo sapiens; identical to SEQ ID NO: 957

SEQ ID NO: 1021 - DNA, 201 bp, Homo sapiens; identical to SEQ ID NO: 1001

SEQ ID NO: 1022 - DNA, 201 bp, Homo sapiens; identical to SEQ ID NO: 1002

SEQ ID NO: 1023 - DNA, 201 bp, Homo sapiens; identical to SEQ ID NO: 1003

SEQ ID NO: 1024 - DNA, 201 bp, Homo sapiens; identical to SEQ ID NO: 1004

SEQ ID NO: 1025 - DNA, 201 bp, Homo sapiens; identical to SEQ ID NO: 1005

SEQ ID NO: 1026 - DNA, 201 bp, Homo sapiens; identical to SEQ ID NO: 956

SEQ ID NO: 1027 - DNA, 201 bp, Homo sapiens; identical to SEQ ID NO: 957

SEQ ID NO: 1028 - DNA, 201 bp, Homo sapiens; identical to SEQ ID NO: 958

SEQ ID NO: 1029 - DNA, 201 bp, Homo sapiens; identical to SEQ ID NO: 959

SEQ ID NO: 1030 - DNA, 201 bp, Homo sapiens; identical to SEQ ID NO: 960

SEQ ID NO: 1031 - DNA, 201 bp, Homo sapiens; identical to SEQ ID NO: 961

SEQ ID NO: 1032 - DNA, 201 bp, Homo sapiens; identical to SEQ ID NO: 962

SEQ ID NO: 1033 - DNA, 201 bp, Homo sapiens; identical to SEQ ID NO: 963

SEQ ID NO: 1034 - DNA, 201 bp, Homo sapiens; identical to SEQ ID NO: 984

SEQ ID NO: 1035 - DNA, 201 bp, Homo sapiens; identical to SEQ ID NO: 965

SEQ ID NO: 1036 - DNA, 201 bp, Homo sapiens; identical to SEQ ID NO: 1001

SEQ ID NO: 1037 - DNA, 201 bp, Homo sapiens; identical to SEQ ID NO: 1002

SEQ ID NO: 1038 - DNA, 201 bp, Homo sapiens; identical to SEQ ID NO: 1003

SEQ ID NO: 1039 - DNA, 201 bp, Homo sapiens; identical to SEQ ID NO: 1004

SEQ ID NO: 1040 - DNA, 201 bp, Homo sapiens
gaaccatggtgtcaatacatatcatgtagcttctgaaaaactccactgtacacttatagaatgaagaaggcaaaaaactttttttttttttttttgagackgagtctcgctctgtcgcccaggctggagtgcagtggcgcgatctcggctcactgcaagctccgcctctcgggttcacgccattctcctgcctcagcctcc

SEQ ID NO: 1041 - DNA, 201 bp, Homo sapiens; identical to SEQ ID NO: 966

SEQ ID NO: 1042 - DNA, 201 bp, Homo sapiens; identical to SEQ ID NO: 967

SEQ ID NO: 1043 - DNA, 201 bp, Homo sapiens
ccctcttgtgcggttcaccacagttgtatttaagtgatcgtgtgagtcgtcgttaaatgcctgtctccccgcggatcatgggctcctcgaggacagggacyggcctgtctgtccactgctgtaaccccgcgccggcatagggacctaaggcccactggagggcgctcatcaagtagctgctggatgttgacgaaggaagcg

SEQ ID NO: 1044 - DNA, 201 bp, Homo sapiens
actggcctgtctgtccactgctgtaaccccgcgccggcatagggacctaaggcccactggagggcgctcatcaagtagctgctggatgttgacgaaggaarcggcggcgcagctcagggatctccgagtcaggacggtcggccagacccacggggtaacgggtctaatcgtgtaggaataaagctgtattccagtgcttcc

SEQ ID NO: 1045 - DNA, 158 bp, Homo sapiens
ctaaggcccactggagggcgctcatcaagtagctgctggatgttgacgaaggaagcggcggcgcagctcagggatctccgagtcaggacggtcggccagasccacggggtaacgggtctaatcgtgtaggaataaagctgtattccagtgcttccaaa

SEQ ID NO: 1046 - DNA, 201 bp, Homo sapiens
cagtcctttctgagttgcgacggctccagaatgaatgtcgtggctataacctccaacctgaccatgatatccagaggtggctacaggggctccggccactkacagaggctcagagccatcgtgtatcctgtgaggtggagccacctggttccagtgaccctcctgccccacgggtgcttcggccaacattggtcatctcgc

SEQ ID NO: 1047 - DNA, 201 bp, Homo sapiens
agccaggacaaggctccaagtgtcatcagtcgtgtccttaagaaaaacaatcgtgactctgcagtggcttcagagtatgagctggtacagctgctaccagrggagcgagagctgactatcccagcctcggctaatgtattctacgccatggatggagcttcacacgatttcctcctgcggcagcggcgaaggtcctctact

SEQ ID NO: 1048 - DNA, 201 bp, Homo sapiens
cagcctccaaggatgagttggagaatggatacatcaattttgacaagcggaggaaggagtttgcagtcctttctgagttgcgacggctccagaatgaatgycgtggctataacctccaacctgaccatgatatccagaggtggctacaggggctccggccactgacagaggctcagagccatcgtgtatcctgtgaggtgg

SEQ ID NO: 1049 - DNA, 201 bp, Homo sapiens
gtggcctggtcgtgggcggggggcaggaggaagaggaggaggaagaagaagaggcccctgtgtccgtctgggatgaggaggaggatggtgccgtgtttacygtcacaagccgccaatatcgacctcttgatcccttggtccctatgcctcccccacgttcctcccgacggctccgagctggcactctggaggccctggtca

SEQ ID NO: 1050 - DNA, 201 bp, Homo sapiens
cctctgctgactcggctggcccagcacatgaagtggccatctgtctcgtcactagactctgccttggaaagcagtccatccctgcacagtccagctgaccycagccacctctccccaccagcctcctcccctaggccttctcgaggtcaccgccgctcagcctcctgtggctccccgctgagtgggggtgcagaagaggcc

SEQ ID NO: 1051 - DNA, 130 bp, Homo sapiens
tagggagggtaatcccgtggggatggagtraccggctctctctccgcctgaaacgcttcccgcgggagttttagccgtgttattgttggggaagggaatgtcaaattctgctcctgccttcccccagggg

SEQ ID NO: 1052 - DNA, 201 bp, Homo sapiens
accatgatatccagaggtggctacaggggctccggccactgacagaggctcagagccatcgtgtatcctgtgaggtggagccacctggttccagtgacccwcctgccccacgggtgcttcggccaacattggtcatctcgcagtggacagaggttttgggctctgttggggtccctaccccgcttgtgtcctgtgaccggc

SEQ ID NO: 1053 - DNA, 201 bp, Homo sapiens
ataacctccaacctgaccatgatatccagaggtggctacaggggctccggccactgacagaggctcagagccatcgtgtatcctgtgaggtggagccaccyggttccagtgaccctcctgccccacgggtgcttcggccaacattggtcatctcgcagtggacagaggttttgggctctgttggggtccctaccccgcttg

SEQ ID NO: 1054 - DNA, 132 bp, Homo sapiens
tcacattgagacagaaattcagaaagggagccagccaccctggggcagtgaagtgccacaaaacgcatcagtttctgattcttggccatatcctaacatgyaagggccaagcaaaggcttcaaggctctgag

SEQ ID NO: 1055 - DNA, 201 bp, Homo sapiens; identical to SEQ ID NO: 1046

SEQ ID NO: 1056 - DNA, 201 bp, Homo sapiens; identical to SEQ ID NO: 1047

SEQ ID NO: 1057 - DNA, 201 bp, Homo sapiens; identical to SEQ ID NO: 1048

SEQ ID NO: 1058 - DNA, 201 bp, Homo sapiens; identical to SEQ ID NO: 1049

SEQ ID NO: 1059 - DNA, 201 bp, Homo sapiens; identical to SEQ ID NO: 1050

SEQ ID NO: 1060 - DNA, 130 bp, Homo sapiens; identical to SEQ ID NO: 1051

SEQ ID NO: 1061 - DNA, 201 bp, Homo sapiens; identical to SEQ ID NO: 1052

SEQ ID NO: 1062 - DNA, 201 bp, Homo sapiens; identical to SEQ ID NO: 1053

SEQ ID NO: 1063 - DNA, 132 bp, Homo sapiens; identical to SEQ ID NO: 1054

SEQ ID NO: 1064 - DNA, 201 bp, Homo sapiens; identical to SEQ ID NO: 1046

SEQ ID NO: 1065 - DNA, 201 bp, Homo sapiens
gtggtcccataccttggcaccttcctgaaggaccttgtgatgctggatgcagcctccaaggtgcagtcctttctgagttgcgacggctccagaatgaatgycgtggctataacctccaacctgaccatgatatccagaggtggctacaggggctccggccactgacagaggctcagagccatcgtgtatcctgtgaggtgg

SEQ ID NO: 1066 - DNA, 201 bp, Homo sapiens
cagctcccccaacccttcctcgcactcgctggtactatgccctgccaccacaggcccctgtgtccgtctgggatgaggaggaggatggtgccgtgtttacygtcacaagccgccaatatcgacctcttgatcccttggtccctatgcctcccccacgttcctcccgacggctccgagctggcactctggaggccctggtca

SEQ ID NO: 1067 - DNA, 201 bp, Homo sapiens; identical to SEQ ID NO: 1053

SEQ ID NO: 1068 - DNA, 201 bp, Homo sapiens; identical to SEQ ID NO: 1052

SEQ ID NO: 1069 - DNA, 201 bp, Homo sapiens; identical to SEQ ID NO: 1050

SEQ ID NO: 1070 - DNA, 201 bp, Homo sapiens; identical to SEQ ID NO: 1047

SEQ ID NO: 1071 - DNA, 201 bp, Homo sapiens
gctgagaaatccagccctgtgggaactggtgtcttataaccaagttggatacctgtgtatagcttcccaccttccatgagtgcagcacacaggtagtgctsgaaaaacgcatcagtttctgattcttggccatatcctaacatgcaagggccaagcaaaggcttcaaggctctgagccccagggcagaggggaatggcaaa

SEQ ID NO: 1072 - DNA, 201 bp, Homo sapiens
ttggatacctgtgtatagcttcccaccttccatgagtgcagcacacaggtagtgctggaaaaacgcatcagtttctgattcttggccatatcctaacatgyaagggccaagcaaaggcttcaaggctctgagccccagggcagaggggaatggcaaaatgtaggtcctcgcaggagctcttcttcccactctgggggtttc

SEQ ID NO: 1073 - DNA, 201 bp, Homo sapiens; identical to SEQ ID NO: 1046

SEQ ID NO: 1074 - DNA, 201 bp, Homo sapiens; identical to SEQ ID NO: 1047

SEQ ID NO: 1075 - DNA, 201 bp, Homo sapiens; identical to SEQ ID NO: 1048

SEQ ID NO: 1076 - DNA, 201 bp, Homo sapiens; identical to SEQ ID NO: 1049

SEQ ID NO: 1077 - DNA, 201 bp, Homo sapiens; identical to SEQ ID NO: 1050

SEQ ID NO: 1078 - DNA, 130 bp, Homo sapiens; identical to SEQ ID NO: 1051

SEQ ID NO: 1079 - DNA, 201 bp, Homo sapiens; identical to SEQ ID NO: 1052

SEQ ID NO: 1080 - DNA, 201 bp, Homo sapiens; identical to SEQ ID NO: 1053

SEQ ID NO: 1081 - DNA, 201 bp, Homo sapiens; identical to SEQ ID NO: 1071

SEQ ID NO: 1082 - DNA, 201 bp, Homo sapiens; identical to SEQ ID NO: 1072

SEQ ID NO: 1083 - DNA, 182 bp, Homo sapiens
ggcgccgggggacacgttggctgcgttttcggcgggcttcccgggtacaaaaatggctgtggctagcgatttctacctgcgstactacgtagggcacaagggcaagtttgggcacgagtttctggagttcgaatttcggccggacggaaagcttagatatgccaacaacagcaattacaaaa

SEQ ID NO: 1084 - DNA, 201 bp, Homo sapiens
tgtggcctccccctgatagggttggccgacaggagcttgaaattgtaattggagatgagcacatatcttttaccacatcaaaaataggttctcttattgaygtaaatcagtcaaaggatcctgaaggccttcgagtattttactatttggtacaagacttgaaatgtttagttttcagtcttattggattacacttcaaga

SEQ ID NO: 1085 - DNA, 201 bp, Homo sapiens
tagggcacaagggcaagtttgggcacgagtttctggagttcgaatttcggccggacggaaagcttagatatgccaacaacagcaattacaaaaatgatgtsatgatcagaaaagaggcttatgtgcacaagagtgtaatggaagaactgaagagaattattgatgacagtgaaattacaaaagaagatgatgctttgtggc

SEQ ID NO: 1086 - DNA, 192 bp, Homo sapiens
ggcgccgggggacacgttggctgcgttttcggcgggcttcccgggtacaaaaatggctgtggctagcgatttctacctgcgctactacgtarggcacaagggcaagtttgggcacgagtttctggagttcgaatttcggccggacggaaagcttagatatgccaacaacagcaattacaaaaatgatgtcat

SEQ ID NO: 1087 - DNA, 201 bp, Homo sapiens
aatgtttagttttcagtcttattggattacacttcaagattaaaccaatttaaattgtatgttttcaggctgtttgtatatttaattaagggatgggaggrgttatttgtcatttacagtattggggtttttatgaatgtgaagcaaacaaaaaaaatttgtatgtaaactgaaaataagaaaatacattagcaagcttaa

SEQ ID NO: 1088 - DNA, 201 bp, Homo sapiens
ggggtttttatgaatgtgaagcaaacaaaaaaaatttgtatgtaaactgaaaataagaaaatacattagcaagcttaatggttatccttacttgagtccayatgggttggacagtccccacacacattaaattctgtaaatgaaagccaccttttgttaaaaatttgctctaataaaacataccaaatcctggttgcagag

SEQ ID NO: 1089 - DNA, 201 bp, Homo sapiens
aaacataccaaatcctggttgcagagtagttttttgttttttccaggaggctatgtctctaattcactttagagataataagaaattgttctggtagatayatcctgtgacagaagatactttaggtggaactatgtagccagattcccatccatgaaaggcaagtgtagattgtcccttatttccttcatacatgattgg

SEQ ID NO: 1090 - DNA, 201 bp, Homo sapiens
taataagaaattgttctggtagatatatcctgtgacagaagatactttaggtggaactatgtagccagattcccatccatgaaaggcaagtgtagattgtyccttatttccttcatacatgattggatttaattttggggggcttatacaaggtctagtttttttttacagttatgacaaacccctcagggattattcaca

SEQ ID NO: 1091 - DNA, 201 bp, Homo sapiens
agattcccatccatgaaaggcaagtgtagattgtcccttatttccttcatacatgattggatttaattttggggggcttatacaaggtctagtttttttttacagttatgacaaacccctcagggattattcacatttaaatattttcagttataagcagtgaggtcctaaagtgttacaagagtacagtctaccccatgt

SEQ ID NO: 1092 - DNA, 201 bp, Homo sapiens
tgattggatttaattttggggggcttatacaaggtctagtttttttttacagttatgacaaacccctcagggattattcacatttaaatattttcagttayaagcagtgaggtcctaaagtgttacaagagtacagtctaccccatgttaggcatatctttgattatgtctttattccttatttcacaatgtatttggtgt

SEQ ID NO: 1093 - DNA, 201 bp, Homo sapiens
tgtctttattccttatttcacaatgtatttggtgtgtaggggaggggggagaactaaatgagttttcagctttataaattgttaaacatttagacaaacakatatgtatgtatgaatgtacataaatatttttaactcctattgaccacgagtctcacttcagtttcccagttcctttcaacctctttctgatagatttcc

SEQ ID NO: 1094 - DNA, 201 bp, Homo sapiens
ggccaaatgaggcctactgattacttgaggtgtgccttgtataactgaatttatggtgctatttaaacaatttttttctaacgtgaaaaggataaaacatwaaaaactcttgagaactataaagtgaacacctatatgcctacccctacctagattctatacttaacatcttttttactgtaatatctctattataataaa

SEQ ID NO: 1095 - DNA, 201 bp, Homo sapiens
tatctctattataataaatcttggtttttcacttaactggtgtaattggtgccaataaactactttttttgtagtgctatttaattttgattaaatttagrtagccacgtgtctagcggctaccgtttggacagtatagctctagagcatggcttggtaacctgtttgccatggagcactagatggtccttttcactcctc

SEQ ID NO: 1096 - DNA, 162 bp, Homo sapiens
ttatactttgatctgtcttttatttgattgtaagttgctgatggacagtgatcattagaaactgaattttgtataatactagttttatatgaaactagatwtttattgcgctcaggttatgttccttttacctccttccttaataaagagaccacttgaaat

SEQ ID NO: 1097 - DNA, 190 bp, Homo sapiens
cactgcaaggcgccgggggacacgttggctgcgttttcggcgggcttcccgggtacaaaaatggctgtggctagcgatttctacctgcgstactacgtagggcacaagggcaagtttgggcacgagtttctggagttcgaatttcggccggacggaaagcttagatatgccaacaacagcaattacaaaa

SEQ ID NO: 1098 - DNA, 102 bp, Homo sapiens
cmctgcaaggcgccgggggacacgttggctgcgttttcggcgggcttcccgggtacaaaaatggctgtggctagcgatttctacctgcgctactacgtaggg

SEQ ID NO: 1099 - DNA, 201 bp, Homo sapiens
tgcttaaagaagcattatttagaaaagcaaaggagcttgaaattgtaattggagatgagcacatatcttttaccacatcaaaaataggttctcttattgaygtaaatcagtcaaaggatcctgaaggccttcgagtattttactatttggtacaagacttgaaatgtttagttttcagtcttattggattacacttcaaga

SEQ ID NO: 1100 - DNA, 201 bp, Homo sapiens
gggcacaagggcaagtttgggcacgagtttctggagttcgaatttcggccggacggaaagcttagatatgccaacaacagcaattacaaaaatgatgtcasgatcagaaaagaggcttatgtgcacaagagtgtaatggaagaactgaagagaattattgatgacagtgaaattacaaaagaagatgatgctttgtggcct

SEQ ID NO: 1101 - DNA, 201 bp, Homo sapiens; identical to SEQ ID NO: 1085

SEQ ID NO: 1102 - DNA, 200 bp, Homo sapiens
cactgcaaggcgccgggggacacgttggctgcgttttcggcgggcttcccgggtacaaaaatggctgtggctagcgatttctacctgcgctactacgtarggcacaagggcaagtttgggcacgagtttctggagttcgaatttcggccggacggaaagcttagatatgccaacaacagcaattacaaaaatgatgtcat

SEQ ID NO: 1103 - DNA, 201 bp, Homo sapiens; identical to SEQ ID NO: 1087

SEQ ID NO: 1104 - DNA, 201 bp, Homo sapiens; identical to SEQ ID NO: 1088

SEQ ID NO: 1105 - DNA, 201 bp, Homo sapiens; identical to SEQ ID NO: 1089

SEQ ID NO: 1106 - DNA, 201 bp, Homo sapiens; identical to SEQ ID NO: 1090

SEQ ID NO: 1107 - DNA, 201 bp, Homo sapiens; identical to SEQ ID NO: 1091

SEQ ID NO: 1108 - DNA, 201 bp, Homo sapiens; identical to SEQ ID NO: 1092

SEQ ID NO: 1109 - DNA, 201 bp, Homo sapiens; identical to SEQ ID NO: 1093

SEQ ID NO: 1110 - DNA, 201 bp, Homo sapiens; identical to SEQ ID NO: 1094

SEQ ID NO: 1111 - DNA, 201 bp, Homo sapiens; identical to SEQ ID NO: 1095

SEQ ID NO: 1112 - DNA, 162 bp, Homo sapiens; identical to SEQ ID NO: 1096

SEQ ID NO: 1113 - DNA, 198 bp, Homo sapiens
gatgacgtcactgcaaggcgccgggggacacgttggctgcgttttcggcgggcttcccgggtacaaaaatggctgtggctagcgatttctacctgcgstactacgtagggcacaagggcaagtttgggcacgagtttctggagttcgaatttcggccggacggaaagcttagatatgccaacaacagcaattacaaaa

SEQ ID NO: 1114 - DNA, 110 bp, Homo sapiens
gatgacgtcmctgcaaggcgccgggggacacgttggctgcgttttcggcgggcttcccgggtacaaaaatggctgtggctagcgatttctacctgcgctactacgtaggg

SEQ ID NO: 1115 - DNA, 201 bp, Homo sapiens; identical to SEQ ID NO: 1085

SEQ ID NO: 1116 - DNA, 201 bp, Homo sapiens
tcactgcaaggcgccgggggacacgttggctgcgttttcggcgggcttcccgggtacaaaaatggctgtggctagcgatttctacctgcgctactacgtarggcacaagggcaagtttgggcacgagtttctggagttcgaatttcggccggacggaaagcttagatatgccaacaacagcaattacaaaaatgatgtcat

SEQ ID NO: 1117 - DNA, 201 bp, Homo sapiens
agtagtgaaggagtcagtgcatagctctaaatttagacatctttctctgtagtcaccccagccaacgttaggatgttttcacaatgcagtgttatgaatartttctgttgtgtgttaatcacttttattaagaatatgactatgtaaaatttatttttgccaaatcataacttctaaaattcttatttgcatccctatacc

SEQ ID NO: 1118 - DNA, 201 bp, Homo sapiens
gcagtgttatgaataatttctgttgtgtgttaatcacttttattaagaatatgactatgtaaaatttatttttgccaaatcataacttctaaaattcttayttgcatccctataccccagagagaaacttgattggtggtttctttgttaaaactgatgattgcatttccctctcatattccttcagaataaatgatgttt

SEQ ID NO: 1119 - DNA, 201 bp, Homo sapiens
ggatcaaatataagtaccatcattattagtggttataaatatcaacaagtattttcttctgctctatgagttttggattacacatttgtaaaataggttartaaggttattttcaagattacagagagtacaaagtccctaccactagggcctgacatacagtaggtgctaaagtggtggtggttattaatattacacatt

SEQ ID NO: 1120 - DNA, 201 bp, Homo sapiens
ctttatgtctctggaaagcaattctttgttggtcctaaacttgggggtagtgcgcgtgagcagtctttattttaaggatatagtttatatctaagaaaccrtgtttctttccccctcgccccccactccctctgttggctgctagaaaacttgcaactaaaattgggatctgcttgtagcaagaatacagatacctctggg

SEQ ID NO: 1121 - DNA, 201 bp, Homo sapiens
gtgagcagtctttattttaaggatatagtttatatctaagaaaccatgtttctttccccctcgccccccactccctctgttggctgctagaaaacttgcarctaaaattgggatctgcttgtagcaagaatacagatacctctgggatagatttttatattaactacatttttctgctatattttttaggagcttgaaatt

SEQ ID NO: 1122 - DNA, 201 bp, Homo sapiens
tattaactacatttttctgctatattttttaggagcttgaaattgtaattggagatgagcacatatcttttaccacatcaaaaataggttctcttattgaygtaaatcagtcaaaggatcctgaaggccttcgagtattttactatttggtacaagacttgaaatgtttagttttcagtcttattggattacacttcaaga

SEQ ID NO: 1123 - DNA, 201 bp, Homo sapiens; identical to SEQ ID NO: 1087

SEQ ID NO: 1124 - DNA, 201 bp, Homo sapiens; identical to SEQ ID NO: 1088

SEQ ID NO: 1125 - DNA, 201 bp, Homo sapiens; identical to SEQ ID NO: 1089

SEQ ID NO: 1126 - DNA, 201 bp, Homo sapiens; identical to SEQ ID NO: 1090

SEQ ID NO: 1127 - DNA, 201 bp, Homo sapiens; identical to SEQ ID NO: 1091

SEQ ID NO: 1128 - DNA, 201 bp, Homo sapiens; identical to SEQ ID NO: 1092

SEQ ID NO: 1129 - DNA, 201 bp, Homo sapiens; identical to SEQ ID NO: 1093

SEQ ID NO: 1130 - DNA, 201 bp, Homo sapiens; identical to SEQ ID NO: 1094

SEQ ID NO: 1131 - DNA, 201 bp, Homo sapiens; identical to SEQ ID NO: 1095

SEQ ID NO: 1132 - DNA, 162 bp, Homo sapiens; identical to SEQ ID NO: 1096

SEQ ID NO: 1133 - DNA, 182 bp, Homo sapiens
ggcgccgggggacacgttggctgcgttttcggcgggcttcccgggtacaaaaatggctgtggctagcgatttctacctgcgstactacgtagggcacaagggcaagtttgggcacgagtttctggagttcgaatttcggccggacggacgcatgaagagtaccaagcaagaggggagaggta

SEQ ID NO: 1134 - DNA, 201 bp, Homo sapiens
taatttcacttttgtatatccctgaggattgtgagcttgaaattgtaattggagatgagcacatatcttttaccacatcaaaaataggttctcttattgaygtaaatcagtcaaaggatcctgaaggccttcgagtattttactatttggtacaagacttgaaatgtttagttttcagtcttattggattacacttcaaga

SEQ ID NO: 1135 - DNA, 201 bp, Homo sapiens
ggtttttttgaatgcacgttttgtgctggacaacaagcaaatacaaaattttaaggaaagcttagatatgccaacaacagcaattacaaaaatgatgtcasgatcagaaaagaggcttatgtgcacaagagtgtaatggaagaactgaagagaattattgatgacagtgaaattacaaaagaagatgatgctttgtggcct

SEQ ID NO: 1136 - DNA, 201 bp, Homo sapiens
tgggtttttttgaatgcacgttttgtgctggacaacaagcaaatacaaaattttaaggaaagcttagatatgccaacaacagcaattacaaaaatgatgtsatgatcagaaaagaggcttatgtgcacaagagtgtaatggaagaactgaagagaattattgatgacagtgaaattacaaaagaagatgatgctttgtggc

SEQ ID NO: 1137 - DNA, 201 bp, Homo sapiens
gaggtgaaactgctacccaagtagtgtgcaacagtgtgttttctgacagcgctatccttagagaatgttacattgatcttgcctacctgcaacaagaaagytcatttggatatatattttttgggtttttttgaatgcacgttttgtgctggacaacaagcaaatacaaaattttaaggaaagcttagatatgccaacaac

SEQ ID NO: 1138 - DNA, 192 bp, Homo sapiens
ggcgccgggggacacgttggctgcgttttcggcgggcttcccgggtacaaaaatggctgtggctagcgatttctacctgcgctactacgtarggcacaagggcaagtttgggcacgagtttctggagttcgaatttcggccggacggacgcatgaagagtaccaagcaagaggggagaggtaaagttccaca

SEQ ID NO: 1139 - DNA, 201 bp, Homo sapiens; identical to SEQ ID NO: 1087

SEQ ID NO: 1140 - DNA, 201 bp, Homo sapiens; identical to SEQ ID NO: 1088

SEQ ID NO: 1141 - DNA, 201 bp, Homo sapiens; identical to SEQ ID NO: 1089

SEQ ID NO: 1142 - DNA, 201 bp, Homo sapiens; identical to SEQ ID NO: 1090

SEQ ID NO: 1143 - DNA, 201 bp, Homo sapiens; identical to SEQ ID NO: 1091

SEQ ID NO: 1144 - DNA, 201 bp, Homo sapiens; identical to SEQ ID NO: 1092

SEQ ID NO: 1145 - DNA, 201 bp, Homo sapiens; identical to SEQ ID NO: 1093

SEQ ID NO: 1146 - DNA, 201 bp, Homo sapiens; identical to SEQ ID NO: 1094

SEQ ID NO: 1147 - DNA, 201 bp, Homo sapiens; identical to SEQ ID NO: 1095

SEQ ID NO: 1148 - DNA, 162 bp, Homo sapiens; identical to SEQ ID NO: 1096

SEQ ID NO: 1149 - DNA, 140 bp, Homo sapiens
gtggctgagaagaaggaggcctgagagcgacatgtccccrgcggctcaggcggagcggcccgtggcgctgtttttctgagtccggggtggcctggcagccggccgaggacgagggtcggcgggggctgcccccgtggtgg

SEQ ID NO: 1150 - DNA, 201 bp, Homo sapiens
ccttcggagtcttcattccaaccctcttctgcctctgccggttgtgagaacaaatgactatcctgaacagggtggaggggtgtgggaaagaaaccagccayattggttttggtttctgtatttttcacaatgattaatgaacaaaaacaaagagaaaaaaacacacatcaattaaaggagacaaaaagaggcagagcgagt

SEQ ID NO: 1151 - DNA, 201 bp, Homo sapiens
tcctcttgaggatacttagggtaaactggatccttcctgctcaaggatcctcatttgtatacctagtggaaaggactctgaactcagaggagtcactgttyctttttttaggttagaaattaacagcagggaaatgccatcttattacctgagacgaccagcactgggagttaggtacggtctgaagttatgtctagataa

SEQ ID NO: 1152 - DNA, 201 bp, Homo sapiens
agacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggg

SEQ ID NO: 1153 - DNA, 201 bp, Homo sapiens
gtttgtttccttaatctggctcatttgaaatttcttctccctctcaaccatcccactaagttatagccaagaagggaaggagacacggggatttggggttytctgcttgaatgtcttctcctttaccacctcaccttgttggtacctccctccctggatctctgagccagcagccaggaggacctgacccagcagttcttt

SEQ ID NO: 1154 - DNA, 201 bp, Homo sapiens
ttccagcctgcagcaacagaacacttgaccttaaaagtctcttctggtctttggattagaaaaggcttatgttagcatagcttaagagcaacctcagagayttgagccctactaagtgactgaccactgtttagagtgtctggtatctgatgttcatttattcccatgttcttgtgtgtcacagttcagccagttttggtt

SEQ ID NO: 1155 - DNA, 201 bp, Homo sapiens
ttctggtctttggattagaaaaggcttatgttagcatagcttaagagcaacctcagagatttgagccctactaagtgactgaccactgtttagagtgtctrgtatctgatgttcatttattcccatgttcttgtgtgtcacagttcagccagttttggtttatgcctagagctacttcaaggaactagactaattagctat

SEQ ID NO: 1156 - DNA, 201 bp, Homo sapiens
taagagcaacctcagagatttgagccctactaagtgactgaccactgtttagagtgtctggtatctgatgttcatttattcccatgttcttgtgtgtcacrgttcagccagttttggtttatgcctagagctacttcaaggaactagactaattagctatataggcccagcgatgcttcttattgatcttaatagtatgcc

SEQ ID NO: 1157 - DNA, 201 bp, Homo sapiens
atgtgtttaattttgagtttgctttattagatatgttttttaagagctctgtatatttgaactgctccttatgtgacaaaataggtagctcttgggctcawgtcctgggttttggctctttaatgattactccaggccagcatttagtcgtttgagaattgtagcctgttgttttcgctgtgacttgggtctcagtgctag

SEQ ID NO: 1158 - DNA, 201 bp, Homo sapiens
gctcaccttgggaaacccagggaaagaatcagcaggttctctgccctccctaggggttggggaaggacccaccccggtcagcacagtgccttttcctctcytgctctgagccagggtggggcattccctctagattcaggtttgggcaggggtcctatagtccctgccatggggctgcttccctgtcccttccctcccctt

SEQ ID NO: 1159 - DNA, 201 bp, Homo sapiens
ttgtcctccatgcccctccagaaggacctaggagagtaggtgagctttccaaagtgagagacgaatctttctttctttttttttttaaagggcaggatggktatgctttgggctttctccttctgtggccccggaggaaggagagactgaggcaaggcaaagtgatagtacactgaagcagaaccggaaacacccaggaac

SEQ ID NO: 1160 - DNA, 201 bp, Homo sapiens
aaggacctaggagagtaggtgagctttccaaagtgagagacgaatctttctttctttttttttttaaagggcaggatgggtatgctttgggctttctcctyctgtggccccggaggaaggagagactgaggcaaggcaaagtgatagtacactgaagcagaaccggaaacacccaggaactgttcagaaatctcagaagaa

SEQ ID NO: 1161 - DNA, 201 bp, Homo sapiens
tctttttttttttaaagggcaggatgggtatgctttgggctttctccttctgtggccccggaggaaggagagactgaggcaaggcaaagtgatagtacackgaagcagaaccggaaacacccaggaactgttcagaaatctcagaagaaatctgcttctcttcgatggaaagatataattaacgatcaaagagctctaaga

SEQ ID NO: 1162 - DNA, 201 bp, Homo sapiens
aagaagccttaatgttcaagctttagaaagatcagagcaatttttctctttcagtccaaactaagactctctgtatttaaatctctctggggcaagagggytagatttcctcattttgttatgagactagattggtaccagtagatcagctgcctagcgagggcaggtttcttctttgcatctgtgtggcttgcttccagt

SEQ ID NO: 1163 - DNA, 201 bp, Homo sapiens
cttgcatccaggcagtcttgtgagatgggggcacatagcactggggaaagcagaactccattctcacctctattttgagcttcagtgctttatttcagtaygaggaaaaacaacaacaaactgaagtgcgctttccgtcctttcaaaggacaactgtcgggaagggagagccgagttgcgaggtaggaggggagcactggc

SEQ ID NO: 1164 - DNA, 201 bp, Homo sapiens
tgaaaagaaatttgaccctggattggttctctccttggacttaaggaatcttaccttttccttccacaaagttctcccaggcaaggaccagctgcccattytgagcccagggcagcctcttcaaccattattggtctaacctggcttgtcaggaaaccaagcccacccttccacattgggcctggctgctctattctgtac

SEQ ID NO: 1165 - DNA, 201 bp, Homo sapiens
tgtcaggaaaccaagcccacccttccacattgggcctggctgctctattctgtaccaagtactggagaaaaagcatcaagttcttagcccttgtagcttcyaccctagtttcccatcctctctctgtggaggccaaaccaactctttgccagcagccacaacatgcattgacagcggcacagtgagatataactgatgggc

SEQ ID NO: 1166 - DNA, 201 bp, Homo sapiens
caggaaaccaagcccacccttccacattgggcctggctgctctattctgtaccaagtactggagaaaaagcatcaagttcttagcccttgtagcttctacyctagtttcccatcctctctctgtggaggccaaaccaactctttgccagcagccacaacatgcattgacagcggcacagtgagatataactgatgggcttt

SEQ ID NO: 1167 - DNA, 201 bp, Homo sapiens
tctctctgtggaggccaaaccaactctttgccagcagccacaacatgcattgacagcggcacagtgagatataactgatgggctttgaacctggttggccrgggaagctgtaggggtggatagagctggctttccttctgggctgtctccatctgaccctaccccttccatgtcccaccccactcccaccaaaaagtacaa

SEQ ID NO: 1168 - DNA, 201 bp, Homo sapiens
gccagcagccacaacatgcattgacagcggcacagtgagatataactgatgggctttgaacctggttggccggggaagctgtaggggtggatagagctggstttccttctgggctgtctccatctgaccctaccccttccatgtcccaccccactcccaccaaaaagtacaaaatcaggatgtttttcactgtccattgct

SEQ ID NO: 1169 - DNA, 201 bp, Homo sapiens
ccacaacatgcattgacagcggcacagtgagatataactgatgggctttgaacctggttggccggggaagctgtaggggtggatagagctggctttccttytgggctgtctccatctgaccctaccccttccatgtcccaccccactcccaccaaaaagtacaaaatcaggatgtttttcactgtccattgctttgtgttt

SEQ ID NO: 1170 - DNA, 130 bp, Homo sapiens
ctttccttctgggctgtctccatctgaccctaccccttccatgtcccaccccactcccaccaaaaagtacaaaatcaggatgtttttcactgtccattgckttgtgttttaataaacaatttgcagtgac

SEQ ID NO: 1171 - DNA, 201 bp, Homo sapiens
ttctgcctctgccggttggcaggatgggtatgctttgggctttctccttctgtggccccggaggaaggagagactgaggcaaggcaaagtgatagtacackgaagcagaaccggaaacacccaggaactgttcagaaatctcagaagaaatctgcttctcttcgatggaaagatataattaacgatcaaagagctttttct

SEQ ID NO: 1172 - DNA, 201 bp, Homo sapiens
cccctatgcctcggacaacagcagcctcatgtttcccatcctggtggccttcggagtcttcattccaaccctcttctgcctctgccggttggcaggatggktatgctttgggctttctccttctgtggccccggaggaaggagagactgaggcaaggcaaagtgatagtacactgaagcagaaccggaaacacccaggaac

SEQ ID NO: 1173 - DNA, 140 bp, Homo sapiens; identical to SEQ ID NO: 1149

SEQ ID NO: 1174 - DNA, 201 bp, Homo sapiens
cagcctcatgtttcccatcctggtggccttcggagtcttcattccaaccctcttctgcctctgccggttggcaggatgggtatgctttgggctttctcctyctgtggccccggaggaaggagagactgaggcaaggcaaagtgatagtacactgaagcagaaccggaaacacccaggaactgttcagaaatctcagaagaa

SEQ ID NO: 1175 - DNA, 201 bp, Homo sapiens
cttctcttcgatggaaagatataattaacgatcaaagagctttttctctttcagtccaaactaagactctctgtatttaaatctctctggggcaagagggytagatttcctcattttgttatgagactagattggtaccagtagatcagctgcctagcgagggcaggtttcttctttgcatctgtgtggcttgcttccagt

SEQ ID NO: 1176 - DNA, 201 bp, Homo sapiens
agagcaggatggatctcttgggacaggttcccccaggagtataaacacaaggagccaggattgtgctgtctattttgagcttcagtgctttatttcagtaygaggaaaaacaacaacaaactgaagtgcgctttccgtcctttcaaaggacaactgtcgggaagggagagccgagttgcgaggtaggaggggagcactggc

SEQ ID NO: 1177 - DNA, 162 bp, Homo sapiens
ttgcgaggtaggaggggagcactggcagggagagacattcttgactcctctcttccctggtgtgttgtgatccagggcaggcaaggaccagctgcccattytgagcccagggcagcctcttcaaccattattggtctaacctggcttgtcaggaaaccaagc

SEQ ID NO: 1178 - DNA, 201 bp, Homo sapiens
ggatggtagtcttcattccaaccctcttctgcctctgccggttgtgagaacaaatgactatcctgaacagggtggaggggtgtgggaaagaaaccagccayattggttttggtttctgtatttttcacaatgattaatgaacaaaaacaaagagaaaaaaacacacatcaattaaaggagacaaaaagaggcagagcgagt

SEQ ID NO: 1179 - DNA, 140 bp, Homo sapiens; identical to SEQ ID NO: 1149

SEQ ID NO: 1180 - DNA, 201 bp, Homo sapiens; identical to SEQ ID NO: 1151

SEQ ID NO: 1181 - DNA, 201 bp, Homo sapiens; identical to SEQ ID NO: 1152

SEQ ID NO: 1182 - DNA, 168 bp, Homo sapiens
gtttgtttccttaatctggctcatttgaaatttcttctccctctcaaccatcccactaagttatagccaagaagggaaggagacacggggatttggggttytctgcttgaatgtcttctcctttaccacctcaccttgttggtacctccctccctggatctctgagcc

SEQ ID NO: 1183 - DNA, 201 bp, Homo sapiens
gctctccccctcctgcccagatgccctggcgcccaaggacccctgcacggccaaccccttccgcaagtcctgggcccagaagcagtgcagcatcctccacrgccccaccttcgccgcctgccacgcacacgtggagccggccaggtactacgaggcctgcgtgaacgacgcgtgcgcctgcgactccgggggtgactgcga

SEQ ID NO: 1184 - DNA, 201 bp, Homo sapiens
actgccgaaatgccacgcccggggacacaggggctggctgtcagaagagctgccacacactggacatgacctgttacagcccccagtgtgtgcctggctgygtgtgccccgacgggctggtggcggacggcgagggcggctgcatcactgcggaggactgcccctgcgtgcacaatgaggccagctaccgggccggccaga

SEQ ID NO: 1185 - DNA, 201 bp, Homo sapiens
ctacaaccccgaaggccagtgcgagtggcactaccagccctgcggggtgccctgcctgcgcacctgccggaacccccgtggagactgcctgcgggacgtcyggggcctggaaggctgctaccccaagtgcccaccagaggctcccatctttgatgaggacaagatgcagtgtgtggccacctgcccaaccccgcctctgcc

SEQ ID NO: 1186 - DNA, 201 bp, Homo sapiens
gccccaggactggcggggccctgacttctgcccccagaagtgccccaacaacatgcagtaccacgagtgccgctccccctgcgcagacacctgctccaacsaggagcactcccgggcctgtgaggaccactgtgtggccggctgcttctgccctgaggggacggtgcttgacgacatcggccagaccggctgtgtccctgt

SEQ ID NO: 1187 - DNA, 201 bp, Homo sapiens
aaggccatcaagattttcctggggttcgagctgaagctaagccatgggaaggtggaggtgatcgggacggacgagagccaggaggtgccatacaccatccrgcagatgggcatctacctggtggtggacaccgacattggcctggtgctgctgtgggacaagaagaccagcatcttcatcaacctcagccccgagttcaag

SEQ ID NO: 1188 - DNA, 201 bp, Homo sapiens
gccccaggactggcggggccctgacttctgcccccagaagtgccccaacaacatgcagtaccacgagtgccgctccccctgcgcagacacctgctccaacyaggagcactcccgggcctgtgaggaccactgtgtggccggctgcttctgccctgaggggacggtgcttgacgacatcggccagaccggctgtgtccctgt

SEQ ID NO: 1189 - DNA, 201 bp, Homo sapiens
ctggctgcgtgtgccccgacgggctggtggcggacggcgagggcggctgcatcactgcggaggactgcccctgcgtgcacaatgaggccagctaccgggcyggccagaccatccgggtgggctgcaacacctgcacctgtgacagcaggatgtggcggtgcacagatgacccctgcctggccacctgcgccgtgtacgggg

SEQ ID NO: 1190 - DNA, 201 bp, Homo sapiens
tactcccggcagtgcacccatgcaggggggttgccccaggactggcggggccctgacttctgcccccagaagtgccccaacaacatgcagtaccacgagtrccgctccccctgcgcagacacctgctccaaccaggagcactcccgggcctgtgaggaccactgtgtggccggctgcttctgccctgaggggacggtgctt

SEQ ID NO: 1191 - DNA, 201 bp, Homo sapiens
tgtgacagcagtgccttcactgtactggctgagctgcgcaggtgcgggctgacggacagcgagacctgcctgaagagcgtgacactgagcctggatggggygcagacggtggtggtgatcaaggccagtggggaagtgttcctgaaccagatctacacccagctgcccatctctgcagccaacgtcaccatcttcagaccc

SEQ ID NO: 1192 - DNA, 201 bp, Homo sapiens
cctggcggaccccgagcatctgccctctgttctgcgactactacaaccccgaaggccagtgcgagtggcactaccagccctgcggggtgccctgcctgcgyacctgccggaacccccgtggagactgcctgcgggacgtccggggcctggaaggctgctaccccaagtgcccaccagaggctcccatctttgatgaggaca

SEQ ID NO: 1193 - DNA, 201 bp, Homo sapiens
tgtggaaccacgatgacagcctgctgctggagctggacaccaaatacgccaacaagacctgtgggctctgtggggacttcaacgggatgcccgtggtcagsgagctcctctcccacaacaccaagctgacacccatggaattcgggaacctgcagaagatggacgaccccacggagcagtgtcaggaccctgtccctgaac

SEQ ID NO: 1194 - DNA, 201 bp, Homo sapiens
acctcaccttcgacggacagagctacagcttcaacggagactgcgagtacacgctggtgcagaaccactgtggcgggaaagacagcacccaggactccttycgtgttgtcaccgagaacgtcccctgcggcaccacagggaccacctgctccaaggccatcaagattttcctggggttcgagctgaagctaagccatggga

SEQ ID NO: 1195 - DNA, 201 bp, Homo sapiens
cctgcacccggcacacaggccatgcccaggatggctcctccgaatccagctacaagcaccaccctgccctctctcctatcgcccgggggcccagcggggtyccgctccgtggggcgactgtcttcccatctctgaggaccatccctgtggtacgagcctccaacccggcgcacaacgggcgggtgtgcagcacctggggca

SEQ ID NO: 1196 - DNA, 169 bp, Homo sapiens
atgagtgttggccggaggaagctggccctgctctgggccctggctctcgctctggcctgcacccggcayacaggccatgcccaggatggctcctccgaatccagctacaagcaccaccctgccctctctcctatcgcccgggggcccagcggggtcccgctccgtgggg

SEQ ID NO: 1197 - DNA, 201 bp, Homo sapiens
cggcacacaggccatgcccaggatggctcctccgaatccagctacaagcaccaccctgccctctctcctatcgcccgggggcccagcggggtcccgctccrtggggcgactgtcttcccatctctgaggaccatccctgtggtacgagcctccaacccggcgcacaacgggcgggtgtgcagcacctggggcagcttccac

SEQ ID NO: 1198 - DNA, 201 bp, Homo sapiens
gcacccatgcaggggggttgccccaggactggcggggccctgacttctgcccccagaagtgccccaacaacatgcagtaccacgagtgccgctccccctgygcagacacctgctccaaccaggagcactcccgggcctgtgaggaccactgtgtggccggctgcttctgccctgaggggacggtgcttgacgacatcggcc

SEQ ID NO: 1199 - DNA, 201 bp, Homo sapiens
ccagctaccgggccggccagaccatccgggtgggctgcaacacctgcacctgtgacagcaggatgtggcggtgcacagatgacccctgcctggccacctgygccgtgtacggggacggccactacctcaccttcgacggacagagctacagcttcaacggagactgcgagtacacgctggtgcagaaccactgtggcggga

SEQ ID NO: 1200 - DNA, 201 bp, Homo sapiens
ggcctgcacccggcacacaggccatgcccaggatggctcctccgaatccagctacaagcaccaccctgccctctctcctatcgcccgggggcccagcgggktcccgctccgtggggcgactgtcttcccatctctgaggaccatccctgtggtacgagcctccaacccggcgcacaacgggcgggtgtgcagcacctgggg

SEQ ID NO: 1201 - DNA, 201 bp, Homo sapiens
ccggctgtgtccctgtgtcaaagtgtgcctgcgtctacaacggggctgcctatgccccaggggccacctactccacagactgcaccaactgcacctgctcyggaggccggtggagctgccaggaggttccatgcccgggtacctgctctgtgcttggaggtgcccacttctcaacgtttgacgggaagcaatacacggtgc

SEQ ID NO: 1202 - DNA, 201 bp, Homo sapiens
ccatggtgttctttgactgccgaaatgccacgcccggggacacaggggctggctgtcagaagagctgccacacactggacatgacctgttacagcccccartgtgtgcctggctgcgtgtgccccgacgggctggtggcggacggcgagggcggctgcatcactgcggaggactgcccctgcgtgcacaatgaggccagct

SEQ ID NO: 1203 - DNA, 115 bp, Homo sapiens
gctctccccctcctgcccagatgccctggcgcccaaggacccctgcacggccaaccccttccgcaagtcctgggcccagaagcagtgcagcatcctccacrgccccaccttcgcc

SEQ ID NO: 1204 - DNA, 201 bp, Homo sapiens; identical to SEQ ID NO: 1184

SEQ ID NO: 1205 - DNA, 201 bp, Homo sapiens; identical to SEQ ID NO: 1186

SEQ ID NO: 1206 - DNA, 201 bp, Homo sapiens
gccatcaagattttcctggggggcttcgagctgaagctaagccatgggaaggtggaggtgatcgggacggacgagagccaggaggtgccatacaccatccrgcagatgggcatctacctggtggtggacaccgacattggcctggtgctgctgtgggacaagaagaccagcatcttcatcaacctcagccccgagttcaag

SEQ ID NO: 1207 - DNA, 201 bp, Homo sapiens; identical to SEQ ID NO: 1188

SEQ ID NO: 1208 - DNA, 201 bp, Homo sapiens; identical to SEQ ID NO: 1189

SEQ ID NO: 1209 - DNA, 201 bp, Homo sapiens; identical to SEQ ID NO: 1190

SEQ ID NO: 1210 - DNA, 201 bp, Homo sapiens; identical to SEQ ID NO: 1191

SEQ ID NO: 1211 - DNA, 201 bp, Homo sapiens; identical to SEQ ID NO: 1193

SEQ ID NO: 1212 - DNA, 201 bp, Homo sapiens
acctcaccttcgacggacagagctacagcttcaacggagactgcgagtacacgctggtgcagaaccactgtggcgggaaagacagcacccaggactccttycgtgttgtcaccgagaacgtcccctgcggcaccacagggaccacctgctccaaggccatcaagattttcctggggggcttcgagctgaagctaagccatg

SEQ ID NO: 1213 - DNA, 201 bp, Homo sapiens
cccctcctctttctgcaggccatgcccaggatggctcctccgaatccagctacaagcaccaccctgccctctctcctatcgcccgggggcccagcggggtyccgctccgtggggcgactgtcttcccatctctgaggaccatccctgtggtacgagcctccaacccggcgcacaacgggcgggtgtgcagcacctggggca

SEQ ID NO: 1214 - DNA, 169 bp, Homo sapiens
atgagtgttggccggaggaagctggccctgctctgggccctggctctcgctctggcctgcacccggcayacagcccccctcctctttctgcaggccatgcccaggatggctcctccgaatccagctacaagcaccaccctgccctctctcctatcgcccgggggcccag

SEQ ID NO: 1215 - DNA, 201 bp, Homo sapiens
ctttctgcaggccatgcccaggatggctcctccgaatccagctacaagcaccaccctgccctctctcctatcgcccgggggcccagcggggtcccgctccrtggggcgactgtcttcccatctctgaggaccatccctgtggtacgagcctccaacccggcgcacaacgggcgggtgtgcagcacctggggcagcttccac

SEQ ID NO: 1216 - DNA, 201 bp, Homo sapiens; identical to SEQ ID NO: 1198

SEQ ID NO: 1217 - DNA, 201 bp, Homo sapiens; identical to SEQ ID NO: 1199

SEQ ID NO: 1218 - DNA, 201 bp, Homo sapiens
cccccctcctctttctgcaggccatgcccaggatggctcctccgaatccagctacaagcaccaccctgccctctctcctatcgcccgggggcccagcgggktcccgctccgtggggcgactgtcttcccatctctgaggaccatccctgtggtacgagcctccaacccggcgcacaacgggcgggtgtgcagcacctgggg

SEQ ID NO: 1219 - DNA, 201 bp, Homo sapiens; identical to SEQ ID NO: 1201

SEQ ID NO: 1220 - DNA, 201 bp, Homo sapiens; identical to SEQ ID NO: 1202

SEQ ID NO: 1221 - DNA, 201 bp, Homo sapiens
aaggctgcttctgtccggagggcatgaccctcttcagcaccagtgcccaagtctgcgtgcccacgggctgccccaggtgtctggggccccacggagagccrgtgaaggtgggccacaccgtcggcatggactgccaggagtgcacgtgtgaggcggccacgtggacgctgacctgccgacccaagctctgcccgctgcccc

SEQ ID NO: 1222 - DNA, 201 bp, Homo sapiens
gcggtgcggaggacgggctctcctgcccgaggtccatcatcctggagtaccaccaggaccgcgtggtgctgacccgcaagccagtccacggggtgatgacraacgagatcatcttcaacaacaaggtggtcagccccggcttccggaaaaacggcatcgtggtctcgcgcatcggcgtcaagatgtacgcgaccatcccgg

SEQ ID NO: 1223 - DNA, 201 bp, Homo sapiens
ctgcctgccccctgcccggcttcgtgcctgtgcctgcagccccacaggccggccagtgctgcccccagtacagctgcgcctgcaacaccagccgctgcccsgcgcccgtgggctgtcctgagggcgcccgcgcgatcccgacctaccaggagggggcctgctgcccagtccaaaactgcagctggacagtgtgcagcatca

SEQ ID NO: 1224 - DNA, 201 bp, Homo sapiens
accagccagcctgccaccggcctcacccgacgcccaccacggtcgggcccaccacagttgggtctaccacggtcgggcccaccacagttgggtctaccacsgtcgggcccaccacaccgcctgctccgtgcctgccatcacccatctgccagctgattctgagcaaggtctttgagccgtgccacactgtgatccccccac

SEQ ID NO: 1225 - DNA, 201 bp, Homo sapiens
ctgcaccgacggctccagccgggccttcagctacaccgaggtggaagagtgcggctgcatgggccggcggtgccctgcgccgggcgacacccagcactcgraggaggcggaacccgagcccagccaggaggcagagagtgggagctgggagagaggcgtcccagtgtcccccatgcactgaccagcactgccgccctcctg

SEQ ID NO: 1226 - DNA, 201 bp, Homo sapiens
tgcctgccccctgcccggcttcgtgcctgtgcctgcagccccacaggccggccagtgctgcccccagtacagctgcgcctgcaacaccagccgctgccccrcgcccgtgggctgtcctgagggcgcccgcgcgatcccgacctaccaggagggggcctgctgcccagtccaaaactgcagctggacagtgtgcagcatcaa

SEQ ID NO: 1227 - DNA, 201 bp, Homo sapiens
tgcggacctcgctgaggaatgtgaccctgcactgcaccgacggctccagccgggccttcagctacaccgaggtggaagagtgcggctgcatgggccggcgstgccctgcgccgggcgacacccagcactcggaggaggcggaacccgagcccagccaggaggcagagagtgggagctgggagagaggcgtcccagtgtccc

SEQ ID NO: 1228 - DNA, 201 bp, Homo sapiens
cagggaaccactgtgtgacccaccagtgtgagaagcaccaggatgggctcgtggtggtcaccacgaagaaggcgtgccccccgctcagctgttctctggaygaggcccgcatgagcaaggacggctgctgccgcttctgcccgccgcccccgcccccgtaccagaaccagtcgacctgtgctgtgtaccataggagcctga

SEQ ID NO: 1229 - DNA, 201 bp, Homo sapiens
gcctgccccctgcccggcttcgtgcctgtgcctgcagccccacaggccggccagtgctgcccccagtacagctgcgcctgcaacaccagccgctgccccgmgcccgtgggctgtcctgagggcgcccgcgcgatcccgacctaccaggagggggcctgctgcccagtccaaaactgcagctggacagtgtgcagcatcaac

SEQ ID NO: 1230 - DNA, 201 bp, Homo sapiens
ccacagttgggtctaccacggtcgggcccaccacagttgggtctaccaccgtcgggcccaccacaccgcctgctccgtgcctgccatcacccatctgccasctgattctgagcaaggtctttgagccgtgccacactgtgatccccccactgctgttctatgagggctgcgtctttgaccggtgccacatgacggacctgg

SEQ ID NO: 1231 - DNA, 201 bp, Homo sapiens
tccccccactgctgttctatgagggctgcgtctttgaccggtgccacatgacggacctggatgtggtgtgctccagcctggagctgtacgcggcactctgygcgtcccacgacatctgcatcgattggagaggccggaccggccacatgtgcccattcacctgcccagccgacaaggtgtaccagccctgcggcccgagca

SEQ ID NO: 1232 - DNA, 201 bp, Homo sapiens
tgtgcagcatcaacgggaccctgtaccagcccggcgccgtggtctcctcgagcctgtgcgaaacctgcaggtgtgagctgccgggtggccccccatcggaygcgtttgtggtcagctgtgagacccagatctgcaacacacactgccctgtgggcttcgagtaccaggagcagagcgggcagtgctgtggcacctgtgtgc

SEQ ID NO: 1233 - DNA, 201 bp, Homo sapiens
gcttcgagtaccaggagcagagcgggcagtgctgtggcacctgtgtgcaggtcgcctgtgtcaccaacaccagcaagagccccgcccacctcttctacccyggcgagacctggtcagacgcagggaaccactgtgtgacccaccagtgtgagaagcaccaggatgggctcgtggtggtcaccacgaagaaggcgtgccccc

SEQ ID NO: 1234 - DNA, 201 bp, Homo sapiens
gcatgaccctcttcagcaccagtgcccaagtctgcgtgcccacgggctgccccaggtgtctggggccccacggagagccggtgaaggtgggccacaccgtyggcatggactgccaggagtgcacgtgtgaggcggccacgtggacgctgacctgccgacccaagctctgcccgctgccccctgcctgccccctgcccggct

SEQ ID NO: 1235 - DNA, 201 bp, Homo sapiens
gggctcgtggtggtcaccacgaagaaggcgtgccccccgctcagctgttctctggacgaggcccgcatgagcaaggacggctgctgccgcttctgcccgcygcccccgcccccgtaccagaaccagtcgacctgtgctgtgtaccataggagcctgatcatccagcagcagggctgcagctcctcggagcccgtgcgcctg

SEQ ID NO: 1236 - DNA, 201 bp, Homo sapiens
cggtgacctctgtgaccccatatgggacttctcctaccaatgctctgtatccttccctgtctacttccatggtatccgcctccgtggcatccacctctgtrgcatccagctctgtggcatccagctctgtggcttactccacccaaacctgcttctgcaacgtggctgaccggctctaccctgcaggatccaccatatacc

SEQ ID NO: 1237 - DNA, 201 bp, Homo sapiens
gtgggagctgggagagaggcgtcccagtgtcccccatgcactgaccagcactgccgccctcctgacctccaaggagaacctcccatatgtcctctgagctyggcttccaaggccagtggaacttgtgcccctgtccaggcggctgcagctttgaacacactgtccacgcccgctttcttgtggagggtgtgggctatgggt

SEQ ID NO: 1238 - DNA, 188 bp, Homo sapiens
gcatccagcctgctgttctggggacgtgagcatcacctgagggtctcaggaatgacgcttggacatggtgatcagctgcctggtggctgcaggaggaagamcctcactcctacctcagccctcagcctgcgctcccctcctcagtacacggccaatctgttgcataaatacacttgagcattttgcaa

SEQ ID NO: 1239 - DNA, 140 bp, Homo sapiens
ggaatgacgcttggacatggtgatcagctgcctggtggctgcaggaggaagaacctcactcctacctcagccctcagcctgcgctcccctcctcagtacayggccaatctgttgcataaatacacttgagcattttgcaa

SEQ ID NO: 1240 - DNA, 134 bp, Homo sapiens
acgcttggacatggtgatcagctgcctggtggctgcaggaggaagaacctcactcctacctcagccctcagcctgcgctcccctcctcagtacacggccartctgttgcataaatacacttgagcattttgcaa

SEQ ID NO: 1241 - DNA, 149 bp, Homo sapiens
aggagatcaccaggctccagtgccgagccgagagccacccggaggtgarcattgaacacctgggtcaggtggtgcagtgcagccgtgaagagggcctggtgtgccggaaccaggaccagcagggacccttcaagatgtgcctcaactac

SEQ ID NO: 1242 - DNA, 201 bp, Homo sapiens; identical to SEQ ID NO: 1222

SEQ ID NO: 1243 - DNA, 201 bp, Homo sapiens; identical to SEQ ID NO: 1224

SEQ ID NO: 1244 - DNA, 201 bp, Homo sapiens; identical to SEQ ID NO: 1230

SEQ ID NO: 1245 - DNA, 201 bp, Homo sapiens
tccccccactgctgttctatgagggctgcgtctttgaccggtgccacatgacggacctggatgtggtgtgctccagcctggagctgtacgcggcactctgygcgtcccacgacatctgcatcgattggagaggccggaccggccacatgtgccgtgtggcttcccctccccacagcattcacctgcccagccgacaaggtg

SEQ ID NO: 1246 - DNA, 201 bp, Homo sapiens; identical to SEQ ID NO: 1236

SEQ ID NO: 1247 - DNA, 201 bp, Homo sapiens; identical to SEQ ID NO: 1221

SEQ ID NO: 1248 - DNA, 201 bp, Homo sapiens; identical to SEQ ID NO: 1234

SEQ ID NO: 1249 - DNA, 201 bp, Homo sapiens; identical to SEQ ID NO: 1223

SEQ ID NO: 1250 - DNA, 201 bp, Homo sapiens; identical to SEQ ID NO: 1226

SEQ ID NO: 1251 - DNA, 201 bp, Homo sapiens; identical to SEQ ID NO: 1229

SEQ ID NO: 1252 - DNA, 201 bp, Homo sapiens; identical to SEQ ID NO: 1232

SEQ ID NO: 1253 - DNA, 201 bp, Homo sapiens; identical to SEQ ID NO: 1233

SEQ ID NO: 1254 - DNA, 201 bp, Homo sapiens; identical to SEQ ID NO: 1228

SEQ ID NO: 1255 - DNA, 201 bp, Homo sapiens; identical to SEQ ID NO: 1235

SEQ ID NO: 1256 - DNA, 201 bp, Homo sapiens; identical to SEQ ID NO: 1227

SEQ ID NO: 1257 - DNA, 201 bp, Homo sapiens; identical to SEQ ID NO: 1225

SEQ ID NO: 1258 - DNA, 201 bp, Homo sapiens
gtgggagctgggagagaggcgtcccagtgtcccccatgcactgaccagcactgccgccctcctgacctccaaggagaacctcccatatgtcctctgagctyggcttccaaggccagtggaacttgtgcccctctcaggaccagccccggggctggccgagctcctctggccatgcatccagcctgctgttctggggacgtg

SEQ ID NO: 1259 - DNA, 186 bp, Homo sapiens
gcatccagcctgctgttctggggacgtgagcatcacctgagggtctcaggaatgacgcttggacatggtgatcagctgcctggtggctgcaggaggaagamcctcactcctacctcagccctcagcctgcgctcccctcctcagtacacggccaatctgttgcataaatacacttgagcattttgc

SEQ ID NO: 1260 - DNA, 138 bp, Homo sapiens
ggaatgacgcttggacatggtgatcagctgcctggtggctgcaggaggaagaacctcactcctacctcagccctcagcctgcgctcccctcctcagtacayggccaatctgttgcataaatacacttgagcattttgc

SEQ ID NO: 1261 - DNA, 132 bp, Homo sapiens
acgcttggacatggtgatcagctgcctggtggctgcaggaggaagaacctcactcctacctcagccctcagcctgcgctcccctcctcagtacacggccartctgttgcataaatacacttgagcattttgc

SEQ ID NO: 1262 - DNA, 201 bp, Homo sapiens
gaaacctacaacaacatcatcaggagtggggaaaaaatctgccgccgacctgaggagatcaccaggctccagtgccgagccgagagccacccggaggtgarcattgaacacctgggtcaggtggtgcagtgcagccgtgaagagggcctggtgtgccggaaccaggaccagcagggacccttcaagatgtgcctcaactac

SEQ ID NO: 1263 - DNA, 201 bp, Homo sapiens; identical to SEQ ID NO: 1221

SEQ ID NO: 1264 - DNA, 201 bp, Homo sapiens; identical to SEQ ID NO: 1222

SEQ ID NO: 1265 - DNA, 201 bp, Homo sapiens; identical to SEQ ID NO: 1223

SEQ ID NO: 1266 - DNA, 201 bp, Homo sapiens; identical to SEQ ID NO: 1224

SEQ ID NO: 1267 - DNA, 201 bp, Homo sapiens; identical to SEQ ID NO: 1225

SEQ ID NO: 1268 - DNA, 201 bp, Homo sapiens; identical to SEQ ID NO: 1226

SEQ ID NO: 1269 - DNA, 201 bp, Homo sapiens; identical to SEQ ID NO: 1227

SEQ ID NO: 1270 - DNA, 201 bp, Homo sapiens; identical to SEQ ID NO: 1228

SEQ ID NO: 1271 - DNA, 201 bp, Homo sapiens; identical to SEQ ID NO: 1229

SEQ ID NO: 1272 - DNA, 201 bp, Homo sapiens; identical to SEQ ID NO: 1230

SEQ ID NO: 1273 - DNA, 201 bp, Homo sapiens; identical to SEQ ID NO: 1231

SEQ ID NO: 1274 - DNA, 201 bp, Homo sapiens; identical to SEQ ID NO: 1232

SEQ ID NO: 1275 - DNA, 201 bp, Homo sapiens; identical to SEQ ID NO: 1233

SEQ ID NO: 1276 - DNA, 201 bp, Homo sapiens; identical to SEQ ID NO: 1234

SEQ ID NO: 1277 - DNA, 201 bp, Homo sapiens; identical to SEQ ID NO: 1235

SEQ ID NO: 1278 - DNA, 201 bp, Homo sapiens; identical to SEQ ID NO: 1236

SEQ ID NO: 1279 - DNA, 201 bp, Homo sapiens; identical to SEQ ID NO: 1237

SEQ ID NO: 1280 - DNA, 188 bp, Homo sapiens; identical to SEQ ID NO: 1238

SEQ ID NO: 1281 - DNA, 140 bp, Homo sapiens; identical to SEQ ID NO: 1239

SEQ ID NO: 1282 - DNA, 134 bp, Homo sapiens; identical to SEQ ID NO: 1240

SEQ ID NO: 1283 - DNA, 201 bp, Homo sapiens; identical to SEQ ID NO: 1262

SEQ ID NO: 1284 - DNA, 201 bp, Homo sapiens
caaaaaagggactgtacatggatatttccaagctggaaccgaggcactttctagacgaaggcagccttatccccaggagatgattgaaaatgtaagaactrttctgagcctgcaggccatagccaaagagacaacagcaaggaccaagattggcaaagtgacacatcctctccaaaagaagaacatgcagaacaaatcaaa

SEQ ID NO: 1285 - DNA, 171 bp, Homo sapiens
tctagacgaaggcagccttatccccaggagatgattgaaaatgtaagaactattctgagcctgcaggccatagccaaagagacaacagcaaggaccaagaytggcaaagtgacacatcctctccaaaagaagaacatgcagaacaaatcaaagaacacaaaccacgactga

SEQ ID NO: 1286 - DNA, 201 bp, Homo sapiens
aataacaaaaaagggactgtacatggatatttccaagctggaaccgaggcactttctagacgaaggcagccttatccccaggagatgattgaaaatgtaaraactattctgagcctgcaggccatagccaaagagacaacagcaaggaccaagattggcaaagtgacacatcctctccaaaagaagaacatgcagaacaaa

SEQ ID NO: 1287 - DNA, 201 bp, Homo sapiens
aggcactttctagacgaaggcagccttatccccaggaggggtcagatgagccggcctggcaggcttgtttccctccaccagacaacagcaaggaccaagaytggcaaagtgacacatcctctccaaaagaagaacatgcagaacaaatcaaagaacacaaaccacgactgacaaacacagccacactcgattttaaaaact

SEQ ID NO: 1288 - DNA, 201 bp, Homo sapiens
tctgcaggtcctctcagatcttgtgcggaaggccaggagtcggaacattggcatcttccatccatccttcaacttaagcaagttcctccgacagggtctckgcaaatgcctcccggccaatgtccaccagctcatctccggcaaaataggcatctctcttaccagagtgtctgatggggaaaacgttctggtgtctgactt

SEQ ID NO: 1289 - DNA, 201 bp, Homo sapiens
tggcatcttccatccatccttcaacttaagcaagttcctccgacagggtctctgcaaatgcctcccggccaatgtccaccagctcatctccggcaaaatakgcatctctcttaccagagtgtctgatggggaaaacgttctggtgtctgactttcggtccaaagacgaagtcgtggatgccttggtatgttcctgcttcat

SEQ ID NO: 1290 - DNA, 201 bp, Homo sapiens
tctgctccccgcctccaggtcccaaatgccagtgagcagccaacaggcctccccatgcacacctgagcaggactggccctgctggactccctgctcccccragggctgtccagcagagaccaaagcagaggccaccccgcggtccatcctcaggtccagcctgaacttcttcttgggcaataaagtacctgctggtgctga

SEQ ID NO: 1291 - DNA, 201 bp, Homo sapiens
acacctgagcaggactggccctgctggactccctgctcccccgagggctgtccagcagagaccaaagcagaggccaccccgcggtccatcctcaggtccakcctgaacttcttcttgggcaataaagtacctgctggtgctgaggggctctccacctttcccagtttttcactagagaagagtctgtgagtcacttgagga

SEQ ID NO: 1292 - DNA, 201 bp, Homo sapiens
tctctcttaccagagtgtctgatggggaaaacgttctggtgtctgactttcggtccaaagacgaagtcgtggatgccttggtatgttcctgcttcatcccyttctacagtggccttatccctccttccttcagaggcgtgcgatatgtggatggaggagtgagtgacaacgtacccttcattgatgccaaaacaaccatca

SEQ ID NO: 1293 - DNA, 201 bp, Homo sapiens
tctgcaacaggccccagccaggcctgaagtcatcctcagaagggatggatcctgaggtcgccatgcccagctgggcaaacatgagtctggattcttccccrgagtcggctgccttggctgtgaggctggagggagatgagctgctagaccacctgcgtctcagcatcctgccctgggatgagagcatcctggacaccctct

SEQ ID NO: 1294 - DNA, 201 bp, Homo sapiens
ttctacagtggccttatccctccttccttcagaggcgtgcgatatgtggatggaggagtgagtgacaacgtacccttcattgatgccaaaacaaccatcaycgtgtcccccttctatggggagtacgacatctgccctaaagtcaagtccacgaactttcttcatgtggacatcaccaagctcagtctacgcctctgcaca

SEQ ID NO: 1295 - DNA, 201 bp, Homo sapiens
caccgtgtcccccttctatggggagtacgacatctgccctaaagtcaagtccacgaactttcttcatgtggacatcaccaagctcagtctacgcctctgcmcagggaacctctaccttctctcgagagcttttgtccccccggatctcaaggtgctgggagagatatgccttcgaggatatttggatgcattcaggttctt

SEQ ID NO: 1296 - DNA, 201 bp, Homo sapiens
ttatccctccttccttcagaggcgtgcgatatgtggatggaggagtgagtgacaacgtacccttcattgatgccaaaacaaccatcaccgtgtcccccttytatggggagtacgacatctgccctaaagtcaagtccacgaactttcttcatgtggacatcaccaagctcagtctacgcctctgcacagggaacctctacc

SEQ ID NO: 1297 - DNA, 201 bp, Homo sapiens
gcatctctcttaccagagtgtctgatggggaaaacgttctggtgtctgactttcggtccaaagacgaagtcgtggatgccttggtatgttcctgcttcatscccttctacagtggccttatccctccttccttcagaggcgtgcgatatgtggatggaggagtgagtgacaacgtacccttcattgatgccaaaacaacca

SEQ ID NO: 1298 - DNA, 201 bp, Homo sapiens
ctgaggggctctccacctttcccagtttttcactagagaagagtctgtgagtcacttgaggaggcgagtctagcagattctttcagaggtgctaaagtttyccatctttgtgcagctacctccgcattgctgtgtagtgacccctgcctgtgacgtggaggatcccagcctctgagctgagttggttttatgaaaagctag

SEQ ID NO: 1299 - DNA, 201 bp, Homo sapiens
ccacctttcccagtttttcactagagaagagtctgtgagtcacttgaggaggcgagtctagcagattctttcagaggtgctaaagtttcccatctttgtgyagctacctccgcattgctgtgtagtgacccctgcctgtgacgtggaggatcccagcctctgagctgagttggttttatgaaaagctaggaagcaaccttt

SEQ ID NO: 1300 - DNA, 201 bp, Homo sapiens
tgtaaggaagcgttgttacctgttgaattttgtattatgtgaatcagtgagatgttagtagaataagccttaaaaaaaaaaaaaaatcggttgggtgcagyggcacacggctgtaatcccagcactttgggaggccaaggttggcagatcacctgaggtcaggagttcaagaccagtctggccaacatagcaaaaccctgt

SEQ ID NO: 1301 - DNA, 201 bp, Homo sapiens
caacatagcaaaaccctgtctctactaaaaatacaaaaattatctgggcatggtggtgcatgcctgtaatcccagctattcggaaggctgaggcaggagartcacttgaacccaggaggcggaggttgcggtgagctgagattgcaccatttcattccagcctgggcaacatgagtgaaagtctgactcaaaaaaaaaaaa

SEQ ID NO: 1302 - DNA, 201 bp, Homo sapiens
gaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctc

SEQ ID NO: 1303 - DNA, 197 bp, Homo sapiens
tttaaaaaacaaaataatctagtgtgcagggcattcacctcagccccccaggcaggagccaagcacagcaggagcttccgcctcctctccactggagcacrcaacttgaacctggcttattttctgcagggaccagccccacatggtcagtgagtttctccccatgtgtggcgatgagagagtgtagaaataaagac

SEQ ID NO: 1304 - DNA, 201 bp, Homo sapiens; identical to SEQ ID NO: 1290

SEQ ID NO: 1305 - DNA, 201 bp, Homo sapiens; identical to SEQ ID NO: 1291

SEQ ID NO: 1306 - DNA, 201 bp, Homo sapiens
gagctttcttgaaccagaagtgggctcattttgctttagagatttcaggtgggcttgtccttgtcctagcatcccagatccaccttctgggaagtcatcasattggaggtgatgttggcagcttttgtaaacaaagggtagtgttgtaagctgttgtgtctgcctatgtgtgtgtttgtgtacttggtctcatctctgcag

SEQ ID NO: 1307 - DNA, 201 bp, Homo sapiens; identical to SEQ ID NO: 1298

SEQ ID NO: 1308 - DNA, 201 bp, Homo sapiens; identical to SEQ ID NO: 1299

SEQ ID NO: 1309 - DNA, 112 bp, Homo sapiens
tgtaaggaagcgttgttacctgttgaattttgtattatgtgaatcagtgagatgttagtagaataagccttaaaaaaaaaaaaaaatcggttgggtgcagyggcacacggct

SEQ ID NO: 1310 - DNA, 201 bp, Homo sapiens
tgcccatggtcatgcatactgaggcagaggatgtgtccttccgcttcatgtcccagcgagcttatgggctgctggtggctacgacctccagggactctgcygacaccctgcgtctggagctggatggggggcgtgtcaagctcatggttaacttagactgtatcaggataaactgtaactccagcaaaggaccagagacct

SEQ ID NO: 1311 - DNA, 201 bp, Homo sapiens
atagcctgaaagtggacaccaaagtggtcactcaggttatcaatggtgccaaaaatctggatttgaaaggtgatctctatatggctggtctggcccaaggsatgtacagcaacctcccaaagctcgtggcctctcgagatggctttcagggctgtctagcatcagtggacttgaatggacgcctgccagacctcatcaatg

SEQ ID NO: 1312 - DNA, 201 bp, Homo sapiens
actggggaagaacctgcgaaagggaggcatccatcctgagctatgatggtagcatgtacatgaagatcatcatgcccatggtcatgcatactgaggcagargatgtgtccttccgcttcatgtcccagcgagcttatgggctgctggtggctacgacctccagggactctgccgacaccctgcgtctggagctggatgggg

SEQ ID NO: 1313 - DNA, 201 bp, Homo sapiens
tgtacatgaagatcatcatgcccatggtcatgcatactgaggcagaggatgtgtccttccgcttcatgtcccagcgagcttatgggctgctggtggctacracctccagggactctgccgacaccctgcgtctggagctggatggggggcgtgtcaagctcatggttaacttagactgtatcaggataaactgtaactcca

SEQ ID NO: 1314 - DNA, 201 bp, Homo sapiens
ggcgtgtcaagctcatggttaacttagactgtatcaggataaactgtaactccagcaaaggaccagagaccttgtatgcagggcagaagctcaatgacaaygagtggcacaccgttcgggtggtgcggagaggaaaaagccttaagttaaccgtggatgatgatgtggctgagggtacaatggtgggagaccatacccgtt

SEQ ID NO: 1315 - DNA, 201 bp, Homo sapiens
ccaatattaaaatcaatggaagtgttcggctggttggagaagtcccatcaattttgggaacaacacagacgacctccatgccaccagaaatgtctactacygtcatggaaaccactactacaatggcgactaccacaacccgtaagaatcgctctacagccagcattcagccaacatcagatgatcttgtttcatctgctg

SEQ ID NO: 1316 - DNA, 201 bp, Homo sapiens
cccggcttcaaggggttaattctggatctcaagtatggaaactcggagcctcggcttctggggagccggggtgtccagatggatgccgagggaccctgtgrtgagcgtccctgtgaaaatggtgggatctgctttctcctggacggccaccccacctgtgactgttctaccactggctatggtggcaagctctgctcagaa

SEQ ID NO: 1317 - DNA, 201 bp, Homo sapiens
cgccattcaccgccagtggggagagcgagatcctggacctggaaggagacatgtacctgggagggctgccggagaaccgtgctggccttattctccccacygagctgtggactgccatgctcaactatggctacgtgggctgcatccgcgacctattcattgatgggcgcagcaagaacattcgacagctggcagagatgc

SEQ ID NO: 1318 - DNA, 201 bp, Homo sapiens
gtgccgagactgccgtgctgtccaacaagcaggtgaatgacagcagctggcacttcctcatggtgagccgtgaccgcctgcgcacggtgctgatgcttgayggcgagggccagtctggggagctgcagccccagcggccctacatggatgtggtcagtgacttgttccttggtggagtccctactgacatacgaccttctg

SEQ ID NO: 1319 - DNA, 201 bp, Homo sapiens
aatggcctgatcctcttcactcatggaaagccccaagagaggaaggatgctcggagccagaagaatacaaaagtagacttctttgccgtggaactcctcgktggcaacctgtacttgctgcttgacatgggctctggcaccatcaaagtgaaagccactcagaagaaagccaatgatggggaatggtaccatgtggacatt

SEQ ID NO: 1320 - DNA, 201 bp, Homo sapiens
gtgatggaaccacaaaaggtcacacaagccaaccatgtcatgccagagtacaaaacacatagttctttccccgccccgaatgtgacaatggttttcatagwggtttaattttgtagcctgacatttatggataactctgtccttccatttgctcacttctctcttcacccatcttttttaaaaacaaataaatgaataaag

SEQ ID NO: 1321 - DNA, 201 bp, Homo sapiens
caaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgt

SEQ ID NO: 1322 - DNA, 201 bp, Homo sapiens
aaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtc

SEQ ID NO: 1323 - DNA, 201 bp, Homo sapiens
atttaatagtataatatatatataaataaatatatatacagatatatttatcatggtatgtttgatgggatgactgacacaggaaatctgttaaagtcttraaatggaatgagaatgttgttttaaaagaaaatagcaaaacaacaaaaaagcaaaccttaaaatgtgaagaaagtgtgaattttagttttgtcacagtta

SEQ ID NO: 1324 - DNA, 201 bp, Homo sapiens
aaaacaataaactggttgtatggccatagctatccgaaaagcaagagacaaagcaagacaaatattcacacaaaaatgaagtgtgtcctctggagggtcakatatacaatttcttttgtacagatgaaaatcaatcagctgcttagatttagaaatctactcttgctggtctttgtaagttgcatgaatatttgactttga

SEQ ID NO: 1325 - DNA, 201 bp, Homo sapiens; identical to SEQ ID NO: 1315

SEQ ID NO: 1326 - DNA, 201 bp, Homo sapiens
ggactttagacctaacaaagtctccgaaactagtaggactactaccacatctttatcccctgagctgatccgcttcacagcttcctcctcgtctgggatgktgcccaaattgccagctggcaaaatgaataaccgtgatctcaaaccccagcctgatatagtcttgcttccgttgcccactgcctatgagctagacagcac

SEQ ID NO: 1327 - DNA, 201 bp, Homo sapiens; identical to SEQ ID NO: 1315

SEQ ID NO: 1328 - DNA, 201 bp, Homo sapiens
tttgaaaggcaaattataaaagtaaacaggtttttttgtttggtttttcaatcatagcaatcggaattattttaaattcaaaaattgatgccctcccaaaycccccaaagtaaaaatttgttaaagtgcagattttttttttctttttatgttatgtggtgtggatgtatgtgttgttgcctccctgtatcatcctctgtt

SEQ ID NO: 1329 - DNA, 201 bp, Homo sapiens; identical to SEQ ID NO: 1326

SEQ ID NO: 1330 - DNA, 201 bp, Homo sapiens
tgcccatggtcatgcatactgaggcagaggatgtgtccttccgcttcatgtcccagcgagcttatgggctgctggtggctacgacctccagggactctgcygacaccctgcgtctggagctggatggggggcgtgtcaagctcatggttaacttaggcaaaggaccagagaccttgtatgcagggcagaagctcaatgaca

SEQ ID NO: 1331 - DNA, 201 bp, Homo sapiens; identical to SEQ ID NO: 1311

SEQ ID NO: 1332 - DNA, 201 bp, Homo sapiens; identical to SEQ ID NO: 1312

SEQ ID NO: 1333 - DNA, 201 bp, Homo sapiens
tgtacatgaagatcatcatgcccatggtcatgcatactgaggcagaggatgtgtccttccgcttcatgtcccagcgagcttatgggctgctggtggctacracctccagggactctgccgacaccctgcgtctggagctggatggggggcgtgtcaagctcatggttaacttaggcaaaggaccagagaccttgtatgcag

SEQ ID NO: 1334 - DNA, 201 bp, Homo sapiens
acaccctgcgtctggagctggatggggggcgtgtcaagctcatggttaacttaggcaaaggaccagagaccttgtatgcagggcagaagctcaatgacaaygagtggcacaccgttcgggtggtgcggagaggaaaaagccttaagttaaccgtggatgatgatgtggctgagggtacaatggtgggagaccatacccgtt

SEQ ID NO: 1335 - DNA, 201 bp, Homo sapiens; identical to SEQ ID NO: 1315

SEQ ID NO: 1336 - DNA, 201 bp, Homo sapiens; identical to SEQ ID NO: 1317

SEQ ID NO: 1337 - DNA, 201 bp, Homo sapiens
ggcttgaggaatgtggtggtccctctcttcgttgtttctgccccctgaggttgtgctttctcagggatatgcactctgcacttccattcctgcagtgaaaytaactcgagcttggcagctcgagaggagaatgtggccactttccgaggctcagagtatctgtgctacgacctgtctcagaacccgatccagagcagcagt

SEQ ID NO: 1338 - DNA, 201 bp, Homo sapiens; identical to SEQ ID NO: 1319

SEQ ID NO: 1339 - DNA, 201 bp, Homo sapiens; identical to SEQ ID NO: 1320

SEQ ID NO: 1340 - DNA, 201 bp, Homo sapiens; identical to SEQ ID NO: 1321

SEQ ID NO: 1341 - DNA, 201 bp, Homo sapiens; identical to SEQ ID NO: 1322

SEQ ID NO: 1342 - DNA, 201 bp, Homo sapiens; identical to SEQ ID NO: 1323

SEQ ID NO: 1343 - DNA, 201 bp, Homo sapiens; identical to SEQ ID NO: 1324

SEQ ID NO: 1344 - DNA, 201 bp, Homo sapiens; identical to SEQ ID NO: 1330

SEQ ID NO: 1345 - DNA, 201 bp, Homo sapiens; identical to SEQ ID NO: 1311

SEQ ID NO: 1346 - DNA, 201 bp, Homo sapiens; identical to SEQ ID NO: 1312

SEQ ID NO: 1347 - DNA, 201 bp, Homo sapiens; identical to SEQ ID NO: 1333

SEQ ID NO: 1348 - DNA, 201 bp, Homo sapiens; identical to SEQ ID NO: 1334

SEQ ID NO: 1349 - DNA, 201 bp, Homo sapiens; identical to SEQ ID NO: 1315

SEQ ID NO: 1350 - DNA, 201 bp, Homo sapiens; identical to SEQ ID NO: 1316

SEQ ID NO: 1351 - DNA, 201 bp, Homo sapiens; identical to SEQ ID NO: 1317

SEQ ID NO: 1352 - DNA, 201 bp, Homo sapiens; identical to SEQ ID NO: 1318

SEQ ID NO: 1353 - DNA, 201 bp, Homo sapiens; identical to SEQ ID NO: 1319

SEQ ID NO: 1354 - DNA, 201 bp, Homo sapiens; identical to SEQ ID NO: 1320

SEQ ID NO: 1355 - DNA, 201 bp, Homo sapiens; identical to SEQ ID NO: 1321

SEQ ID NO: 1356 - DNA, 201 bp, Homo sapiens; identical to SEQ ID NO: 1322

SEQ ID NO: 1357 - DNA, 201 bp, Homo sapiens; identical to SEQ ID NO: 1323

SEQ ID NO: 1358 - DNA, 201 bp, Homo sapiens; identical to SEQ ID NO: 1324

SEQ ID NO: 1359 - DNA, 201 bp, Homo sapiens; identical to SEQ ID NO: 1310

SEQ ID NO: 1360 - DNA, 201 bp, Homo sapiens; identical to SEQ ID NO: 1311

SEQ ID NO: 1361 - DNA, 201 bp, Homo sapiens; identical to SEQ ID NO: 1312

SEQ ID NO: 1362 - DNA, 201 bp, Homo sapiens; identical to SEQ ID NO: 1313

SEQ ID NO: 1363 - DNA, 201 bp, Homo sapiens; identical to SEQ ID NO: 1314

SEQ ID NO: 1364 - DNA, 201 bp, Homo sapiens; identical to SEQ ID NO: 1315

SEQ ID NO: 1365 - DNA, 201 bp, Homo sapiens; identical to SEQ ID NO: 1317

SEQ ID NO: 1366 - DNA, 201 bp, Homo sapiens; identical to SEQ ID NO: 1337

SEQ ID NO: 1367 - DNA, 201 bp, Homo sapiens; identical to SEQ ID NO: 1319

SEQ ID NO: 1368 - DNA, 201 bp, Homo sapiens; identical to SEQ ID NO: 1320

SEQ ID NO: 1369 - DNA, 201 bp, Homo sapiens; identical to SEQ ID NO: 1321

SEQ ID NO: 1370 - DNA, 201 bp, Homo sapiens; identical to SEQ ID NO: 1322

SEQ ID NO: 1371 - DNA, 201 bp, Homo sapiens; identical to SEQ ID NO: 1323

SEQ ID NO: 1372 - DNA, 201 bp, Homo sapiens; identical to SEQ ID NO: 1324

SEQ ID NO: 1373 - DNA, 201 bp, Homo sapiens; identical to SEQ ID NO: 1315

SEQ ID NO: 1374 - DNA, 201 bp, Homo sapiens; identical to SEQ ID NO: 1320

SEQ ID NO: 1375 - DNA, 201 bp, Homo sapiens; identical to SEQ ID NO: 1321

SEQ ID NO: 1376 - DNA, 201 bp, Homo sapiens; identical to SEQ ID NO: 1322

SEQ ID NO: 1377 - DNA, 201 bp, Homo sapiens; identical to SEQ ID NO: 1323

SEQ ID NO: 1378 - DNA, 201 bp, Homo sapiens; identical to SEQ ID NO: 1324

SEQ ID NO: 1379 - DNA, 201 bp, Homo sapiens
tccaggcctgaggcccagccagcgcccaatggatgacaaaaagaagaaacggagtcccaagccctgcctggcccagccagcccaggccccaggcacactayggagggtccctgtgcctaccagccacagcggctccttggccctaggacttcctcatctgccatcccccaagcagcgggccaagttcaagagagtaggcaa

SEQ ID NO: 1380 - DNA, 201 bp, Homo sapiens
acgttcgggagatgcaggagaagctagcccggctgcacttcagcctggatgtgtgtggggaggaggaggacgatgaagaggaagaggatggggtcactgargggctgccagaggagcagaagaagacaatggctgaccgtaacctggaccagctgcttagcaatctggaagacctcagtaattctatgtatcctttccaag

SEQ ID NO: 1381 - DNA, 201 bp, Homo sapiens
cgttcgggagatgcaggagaagctagcccggctgcacttcagcctggatgtgtgtggggaggaggaggacgatgaagaggaagaggatggggtcactgagrggctgccagaggagcagaagaagacaatggctgaccgtaacctggaccagctgcttagcaatctggaagacctcagtaattctatgtatcctttccaagg

SEQ ID NO: 1382 - DNA, 201 bp, Homo sapiens
ctaccacctcacctggtcctcagtcagaaacagcgcgagtgcgcgcgcacacaccccagtgtgtctgacctgcacgatctggatgaagagagagggggtgmgagagggcaggcggggactgcaacctcagtccacagacggcccgagaccctcgtccccggccctttgcacaggtgagggaactaaacctgtgcaagatgg

SEQ ID NO: 1383 - DNA, 201 bp, Homo sapiens
gacgggcacagccagaagctgcacctggccgagaacgccgagcctgaggagcagtccgctgcgtaggcgtcccacgcaggcccacactgcccctctcattytcttcaaactgtgactttttacagactcgggcgggtgttctgcggccccccaggtgctatgggggaggggggcgttgaatggaattaaaccagaaagaaa

SEQ ID NO: 1384 - DNA, 201 bp, Homo sapiens
ccacagtgtgccagtactgcaagaagcttctgaaggggcttttcaggcagggcttgcagtgcaaagattgcagattcaactgccataaacgttgtgcaccraaagtaccaaacaactgccttggcgaagtgaccattaatggagatttgcttagccctggggcagagtctgatgtggtcatggaagaagggagtgatgaca

SEQ ID NO: 1385 - DNA, 201 bp, Homo sapiens
ctgtgagtatttcagtatcaaattgccagattcaagaaaatgtggacatcagcacagtatatcagatttttcctgatgaagtactgggttctggacagttwggaattgtttatggaggaaaacatcgtaaaacaggaagagatgtagctattaaaatcattgacaaattacgatttccaacaaaacaagaaagccagcttc

SEQ ID NO: 1386 - DNA, 201 bp, Homo sapiens
cgtcattcccaagggctcctccgtgggtacaggaaccaacttgcacagagatatctctgtgagtatttcagtatcaaattgccagattcaagaaaatgtgkacatcagcacagtatatcagatttttcctgatgaagtactgggttctggacagtttggaattgtttatggaggaaaacatcgtaaaacaggaagagatgt

SEQ ID NO: 1387 - DNA, 201 bp, Homo sapiens
cgctacatcacccatgaaagtgatgacctgaggtgggagaagtatgcaggcgagcaggggctgcagtaccccacacacctgatcaatccaagtgctagccrcagtgacactcctgagactgaagaaacagaaatgaaagccctcggtgagcgtgtcagcatcctctgagttccatctcctataatctgtcaaaacactgtg

SEQ ID NO: 1388 - DNA, 201 bp, Homo sapiens
tcagtatcaaattgccagattcaagaaaatgtggacatcagcacagtatatcagatttttcctgatgaagtactgggttctggacagtttggaattgtttwtggaggaaaacatcgtaaaacaggaagagatgtagctattaaaatcattgacaaattacgatttccaacaaaacaagaaagccagcttcgtaatgaggtt

SEQ ID NO: 1389 - DNA, 201 bp, Homo sapiens
tgtatccaccaaatccctggaaggaaatatctcatgaagccattgatcttatcaacaatttgctgcaagtaaaaatgagaaagcgctacagtgtggataaraccttgagccacccttggctacaggactatcagacctggttagatttgcgagagctggaatgcaaaatcggggagcgctacatcacccatgaaagtgatg

SEQ ID NO: 1390 - DNA, 201 bp, Homo sapiens
gacctggttagatttgcgagagctggaatgcaaaatcggggagcgctacatcacccatgaaagtgatgacctgaggtgggagaagtatgcaggcgagcagsggctgcagtaccccacacacctgatcaatccaagtgctagccacagtgacactcctgagactgaagaaacagaaatgaaagccctcggtgagcgtgtcag

SEQ ID NO: 1391 - DNA, 201 bp, Homo sapiens
atatcgttcactgtgacctcaaaccagaaaatgtgttgctagcctcagctgatccttttcctcaggtgaaactttgtgattttggttttgcccggatcatyggagagaagtctttccggaggtcagtggtgggtacccccgcttacctggctcctgaggtcctaaggaacaagggctacaatcgctctctagacatgtggt

SEQ ID NO: 1392 - DNA, 201 bp, Homo sapiens
caaattcagaatgcagctttcatgtatccaccaaatccctggaaggaaatatctcatgaagccattgatcttatcaacaatttgctgcaagtaaaaatgaraaagcgctacagtgtggataagaccttgagccacccttggctacaggactatcagacctggttagatttgcgagagctggaatgcaaaatcggggagcgc

SEQ ID NO: 1393 - DNA, 201 bp, Homo sapiens
gatttccaacaaaacaagaaagccagcttcgtaatgaggttgcaattctacagaaccttcatcaccctggtgttgtaaatttggagtgtatgtttgagackcctgaaagagtgtttgttgttatggaaaaactccatggagacatgctggaaatgatcttgtcaagtgaaaagggcaggttgccagagcacataacgaagt

SEQ ID NO: 1394 - DNA, 201 bp, Homo sapiens
agtaccccacacacctgatcaatccaagtgctagccacagtgacactcctgagactgaagaaacagaaatgaaagccctcggtgagcgtgtcagcatcctmtgagttccatctcctataatctgtcaaaacactgtggaactaataaatacatacggtcaggtttaacatttgccttgcagaactgccattattttctgtc

SEQ ID NO: 1395 - DNA, 201 bp, Homo sapiens
gtgtcccattggtgttgtcattgtaaacaaactcttgaagagtcgattatttccagtgttctatgaacaactccaaaacccatgtgggaaaaaaatgaatraggagggtagggaataaaatcctaagacacaaatgcatgaacaagttttaatgtatagttttgaatcctttgcctgcctggtgtgcctcagtatatttaa

SEQ ID NO: 1396 - DNA, 201 bp, Homo sapiens; identical to SEQ ID NO: 1384

SEQ ID NO: 1397 - DNA, 201 bp, Homo sapiens; identical to SEQ ID NO: 1385

SEQ ID NO: 1398 - DNA, 201 bp, Homo sapiens; identical to SEQ ID NO: 1386

SEQ ID NO: 1399 - DNA, 201 bp, Homo sapiens; identical to SEQ ID NO: 1387

SEQ ID NO: 1400 - DNA, 201 bp, Homo sapiens; identical to SEQ ID NO: 1388

SEQ ID NO: 1401 - DNA, 201 bp, Homo sapiens; identical to SEQ ID NO: 1389

SEQ ID NO: 1402 - DNA, 201 bp, Homo sapiens; identical to SEQ ID NO: 1390

SEQ ID NO: 1403 - DNA, 201 bp, Homo sapiens
aaatgatcttgtcaagtgaaaagggcaggttgccagagcacataacgaagtttttaattactcaggtgaaactttgtgattttggttttgcccggatcatyggagagaagtctttccggaggtcagtggtgggtacccccgcttacctggctcctgaggtcctaaggaacaagggctacaatcgctctctagacatgtggt

SEQ ID NO: 1404 - DNA, 201 bp, Homo sapiens; identical to SEQ ID NO: 1392

SEQ ID NO: 1405 - DNA, 201 bp, Homo sapiens; identical to SEQ ID NO: 1393

SEQ ID NO: 1406 - DNA, 201 bp, Homo sapiens; identical to SEQ ID NO: 1394

SEQ ID NO: 1407 - DNA, 201 bp, Homo sapiens; identical to SEQ ID NO: 1395

SEQ ID NO: 1408 - DNA, 152 bp, Homo sapiens
aggttgcatcataaatacaaaggactgaagttataaaagagaaaagagaagwttgctgctaaaatgaatctgagcaatatggaatattttgtgccacacacaaaaaggtactgaagatttaccccccaaaaaaaattgtcaatgagaaataa

SEQ ID NO: 1409 - DNA, 201 bp, Homo sapiens
ccaagaaagagaagcaagagcggatctccaaacataaagagaacttgcagcacacacaggctgaagaggaagcccaccttctcactcaacagagactgtaytacgacaaaaattgtcgtttcttcaagcggaaaataatgatcaagcggcacgaggtggagcagcagaacattcgggaggaactaaataaaaagaggaccc

SEQ ID NO: 1410 - DNA, 201 bp, Homo sapiens
ttcctcctcctgttcctccccacctccctccttttccagttcagtatttggagttcaacactgtctctcaatcagatcatcttgatctttttctttatctyccttccccttcctaagtcccatttcttggtcataaatattgcattattcacactttcaaactgtgtattttcttacaataaaaaatgatgaaaaaaaaaa

SEQ ID NO: 1411 - DNA, 201 bp, Homo sapiens
ccctccttttccagttcagtatttggagttcaacactgtctctcaatcagatcatcttgatctttttctttatctcccttccccttcctaagtcccatttyttggtcataaatattgcattattcacactttcaaactgtgtattttcttacaataaaaaatgatgaaaaaaaaaaaggctttacttcttttgcatgcact

SEQ ID NO: 1412 - DNA, 201 bp, Homo sapiens
gcggcggcggcggcgccgggcccgggggtggtgacagcaggtctgaggtaggttgcatcataaatacaaaggactgaagttataaaagagaaaagagaagwttgctgctaaaatgaatctgagcaatatggaatattttgtgccacacacaaaaaggtactgaagatttaccccccaaaaaaaattgtcaatgagaaataa

SEQ ID NO: 1413 - DNA, 201 bp, Homo sapiens; identical to SEQ ID NO: 1409

SEQ ID NO: 1414 - DNA, 201 bp, Homo sapiens; identical to SEQ ID NO: 1410

SEQ ID NO: 1415 - DNA, 201 bp, Homo sapiens; identical to SEQ ID NO: 1411

SEQ ID NO: 1416 - DNA, 153 bp, Homo sapiens
ctattctacaaagatgatcctgaggaactttttattggtttgcatgaaattggacatggaagttttggagcagtttattttgctacaaatgctcacaccartgaggtggtggcaattaagaagatgtcctatagtgggaagcagacccatgag

SEQ ID NO: 1417 - DNA, 201 bp, Homo sapiens; identical to SEQ ID NO: 1412

SEQ ID NO: 1418 - DNA, 201 bp, Homo sapiens; identical to SEQ ID NO: 1409

SEQ ID NO: 1419 - DNA, 201 bp, Homo sapiens; identical to SEQ ID NO: 1410

SEQ ID NO: 1420 - DNA, 201 bp, Homo sapiens; identical to SEQ ID NO: 1411

SEQ ID NO: 1421 - DNA, 201 bp, Homo sapiens
gggtgtgggtggggagactgcagagactcccgagacccccccaagtcagggcttttcgctggtctcgcagccccagcccagcagctgctgcagtcttgcakgttgtggatgcaagcattttgctgaggaaactgcatagcgttcccaggactctagggcccacgacccctcaaaagttaagagccgctgatctaatctaac

SEQ ID NO: 1422 - DNA, 201 bp, Homo sapiens
tctccctcccccggccctcctgctgatgagagacaggagcgatggatggtctgagttagcggggtcccggcaccacccagcgcaaaggcactgcactcacrcacgccatgcacatgctggctcacatcctccatcccatgcctcccctgtctccagcattccctctggaatacatcagcactgttgcctttgaggctggcc

SEQ ID NO: 1423 - DNA, 201 bp, Homo sapiens
cctgtcagctttctctccctcccccggccctcctgctgatgagagacaggagcgatggatggtctgagttagcggggtcccggcaccacccagcgcaaagrcactgcactcacgcacgccatgcacatgctggctcacatcctccatcccatgcctcccctgtctccagcattccctctggaatacatcagcactgttgcc

SEQ ID NO: 1424 - DNA, 201 bp, Homo sapiens
catcctccatcccatgcctcccctgtctccagcattccctctggaatacatcagcactgttgcctttgaggctggcctgcttgaatgcacacctgagctcyggattcacagagtctcactctatcgccaggctggagtggtgcagtggcaagatctcggctcactacagtctccacctccagggttcaagccattctcttg

SEQ ID NO: 1425 - DNA, 201 bp, Homo sapiens
tactggaatcacactgtctcctgtcagctttctctccctcccccggccctcctgctgatgagagacaggagcgatggatggtctgagttagcggggtcccrgcaccacccagcgcaaaggcactgcactcacgcacgccatgcacatgctggctcacatcctccatcccatgcctcccctgtctccagcattccctctgga

SEQ ID NO: 1426 - DNA, 201 bp, Homo sapiens
atgagagacaggagcgatggatggtctgagttagcggggtcccggcaccacccagcgcaaaggcactgcactcacgcacgccatgcacatgctggctcacmtcctccatcccatgcctcccctgtctccagcattccctctggaatacatcagcactgttgcctttgaggctggcctgcttgaatgcacacctgagctccg

SEQ ID NO: 1427 - DNA, 201 bp, Homo sapiens
aaaaaaaaaaaaagaaaaacaccaggtttttgcatcctcctggatgagggatataaagtgcctgacacagcatatgacagggatttgataaatgggggctrttagctgtcccattgtggatgtgagaatagcattctgctggctaaaaggcagacatgaatgttctagaacatggcgatcccggaatgtgcagtgaaggca

SEQ ID NO: 1428 - DNA, 142 bp, Homo sapiens
ctgtgcaattcgggtgagttccttcacccttctgagccatcycttggctcgtctggaaaatgcaaaaaaaaaaaaaagaaaaacaccaggtttttgcatcctcctggatgagggatataaagtgcctgacacagcatatgac

SEQ ID NO: 1429 - DNA, 129 bp, Homo sapiens
ctgtgcaattcgggtgagttccttcaccyttctgagccatcccttggctcgtctggaaaatgcaaaaaaaaaaaaaagaaaaacaccaggtttttgcatcctcctggatgagggatataaagtgcctga

SEQ ID NO: 1430 - DNA, 201 bp, Homo sapiens
gcacatgacagcctccgctgagccaaatggcccaaagacttctgaatgagcttttgctgcaacaaaaaactttggatcattttgagagcctcccgtgaggygccaatatgttgcagtaccttcccggccccgacactgatgtgattcatcgtaggtaacatatgaatacgctcaagctggccagcagcttgaaaaattgga

SEQ ID NO: 1431 - DNA, 201 bp, Homo sapiens
agtctatcaaattgaccttgagaaacacaggaaggtaatatttagtgacataccagatgaaatccttgcgcagagatgtgaggtgaggaaggacctgaagkgaagtagaccagcaaatatcaagggtcaaggagttgggggatgatatagagacgaagcctaacagatgtcaccagagcaagaaggccttacgacttcaca

SEQ ID NO: 1432 - DNA, 201 bp, Homo sapiens
acctgaagtgaagtagaccagcaaatatcaagggtcaaggagttgggggatgatatagagacgaagcctaacagatgtcaccagagcaagaaggccttacracttcacatcctctctgcagggtatgaatggtgcaatggaatgaaatggtaactacagcttctggtgcaaaatttgagtttccataatcatcatcttggg

SEQ ID NO: 1433 - DNA, 201 bp, Homo sapiens
cagagcaagaaggccttacgacttcacatcctctctgcagggtatgaatggtgcaatggaatgaaatggtaactacagcttctggtgcaaaatttgagttwccataatcatcatcttgggaaaatgaggaacacaatataatggcatacacagagaacaagtgaaaagatgagagatgatgaacaggttgagtttcttcag

SEQ ID NO: 1434 - DNA, 201 bp, Homo sapiens
gtgcaatggaatgaaatggtaactacagcttctggtgcaaaatttgagtttccataatcatcatcttgggaaaatgaggaacacaatataatggcatacasagagaacaagtgaaaagatgagagatgatgaacaggttgagtttcttcagcctacaacctatcaaatctaattttaaacatctggagccacgtgtattag

SEQ ID NO: 1435 - DNA, 131 bp, Homo sapiens
atgggccatggggtggagcagacagacttgsagtttggaagccagatggaccaagcaaggagcctgactctgagctcaccagctgtgcaattcgggccaagatcacatgtgcaccatggagggcaaaagac

SEQ ID NO: 1436 - DNA, 163 bp, Homo sapiens
atgggccatggggtggagcagacagacttggagtttggaagccagatggaccaagcaaggagmctgactctgagctcaccagctgtgcaattcgggccaagatcacatgtgcaccatggagggcaaaagacttggcggtttcgaaccctatggtttaaaggaa

SEQ ID NO: 1437 - DNA, 201 bp, Homo sapiens
tgggccatggggtggagcagacagacttggagtttggaagccagatggaccaagcaaggagcctgactctgagctcaccagctgtgcaattcgggccaagrtcacatgtgcaccatggagggcaaaagacttggcggtttcgaaccctatggtttaaaggaaagtcaatgttagaaaacataacatcaacacaagaattcc

SEQ ID NO: 1438 - DNA, 201 bp, Homo sapiens
tccagtggtcacaatggactcgctcaagatactgtggccttgtgaccagccagaaatggacgaggtgccctcttatcccgagcagctcaaggaggaaaaargcatcttctccatttcagatgtgtctttctgggtgaagggatctccatttgcgttaacatccctgaccccctctgccactcacttattcctgctcaaggg

SEQ ID NO: 1439 - DNA, 201 bp, Homo sapiens
cactgaggagtacatgaagatggacctggggccgggccggagggcagcctggcaggagagcactggggtcgagatgggcagactgggccctgcacctcccrgggctgctagcatttgcaggcctacccgggcagtgcccagcagccggggtgactacatgaccatgcagatgagttgtccccgtcagagctacgtggacac

SEQ ID NO: 1440 - DNA, 201 bp, Homo sapiens
cagcggccgtggtgctgcagctgatgaacatcaggcgctgtggccactcggaaaacttcttcttcatcgaggtgggccgttctgccgtgacggggcccggrgagttctggatgcaggtggatgactctgtggtggcccagaacatgcacgagaccatcctggaggccatgcgggccatgagtgatgagttccgccctcgca

SEQ ID NO: 1441 - DNA, 201 bp, Homo sapiens
ggctgtccctgggggatcccaaggccagcaccttacctcgggcccgagagcagcagcagcagcagcagcccttgctgcaccctccagagcccaagagcccsggggaatatgtcaatattgaatttgggagtgatcagtctggctacttgtctggcccggtggctttccacagctcaccttctgtcaggtgtccatcccagc

SEQ ID NO: 1442 - DNA, 201 bp, Homo sapiens
cggacgtgcgcaaggtgggctacctgcgcaaacccaagagcatgcacaaacgcttcttcgtactgcgcgcggccagcgaggctgggggcccggcgcgcctygagtactacgagaacgagaagaagtggcggcacaagtcgagcgcccccaaacgctcgatcccccttgagagctgcttcaacatcaacaagcgggctgact

SEQ ID NO: 1443 - DNA, 201 bp, Homo sapiens
cgagcgcccccaaacgctcgatcccccttgagagctgcttcaacatcaacaagcgggctgactccaagaacaagcacctggtggctctctacacccgggaygagcactttgccatcgcggcggacagcgaggccgagcaagacagctggtaccaggctctcctacagctgcacaaccgtgctaagggccaccacgacggag

SEQ ID NO: 1444 - DNA, 201 bp, Homo sapiens
cgtcccttccgggaccagctatggaaagctgtggacaaacggggtagggggccaccactctcatgtcttgcctcaccccaaacccccagtggagagcagcrgtggtaagctcttaccttgcacaggtgactacatgaacatgtcaccagtgggggactccaacaccagcagcccctccgactgctactacggccctgagga

SEQ ID NO: 1445 - DNA, 201 bp, Homo sapiens
ccccgctcaaccacagccgctccatccccatgccggcttcccgctgctcgccttcggccaccagcccggtcagtctgtcgtccagtagcaccagtggccayggctccacctcggattgtctcttcccacggcgatctagtgcttcggtgtctggttcccccagcgatggcggtttcatctcctcggatgagtatggctcca

SEQ ID NO: 1446 - DNA, 201 bp, Homo sapiens
tgagccccaagagcgtatctgccccacagcagatcatcaatcccatcagacgccatccccagagagtggaccccaatggctacatgatgatgtcccccagyggtggctgctctcctgacattggaggtggccccagcagcagcagcagcagcagcaacgccgtcccttccgggaccagctatggaaagctgtggacaaacg

SEQ ID NO: 1447 - DNA, 201 bp, Homo sapiens
ggcccacaaggacctgggggcatgagcgccttcacccgggtgaacctcagtcctaaccgcaaccagagtgccaaagtgatccgtgcagacccacaagggtrccggcggaggcatagctccgagactttctcctcaacacccagtgccacccgggtgggcaacacagtgccctttggagcgggggcagcagtagggggcggt

SEQ ID NO: 1448 - DNA, 201 bp, Homo sapiens
accatgtcccgcccagcctcggtggacggcagccctgtgagtcccagcaccaacagaacccacgcccaccggcatcggggcagcgcccggctgcacccccsgctcaaccacagccgctccatccccatgccggcttcccgctgctcgccttcggccaccagcccggtcagtctgtcgtccagtagcaccagtggccatggc

SEQ ID NO: 1449 - DNA, 201 bp, Homo sapiens
ctactacggccctgaggacccccagcacaagccagtcctctcctactactcattgccaagatcctttaagcacacccagcgccccggggagccggaggagsgtgcccggcatcagcacctccgcctttccactagctctggtcgccttctctatgctgcaacagcagatgattcttcctcttccaccagcagcgacagcct

SEQ ID NO: 1450 - DNA, 201 bp, Homo sapiens
cgccccggggagccggaggagggtgcccggcatcagcacctccgcctttccactagctctggtcgccttctctatgctgcaacagcagatgattcttcctyttccaccagcagcgacagcctgggtgggggatactgcggggctaggctggagcccagccttccacatccccaccatcaggttctgcagccccatctgcct

SEQ ID NO: 1451 - DNA, 201 bp, Homo sapiens
gcggccctcggggcgggaggtggtgggggcagctgcagcggcagctccggccttggtgaggctggggaggacttgagctacggtgacgtgcccccaggacscgcattcaaagaggtctggcaagtgatcctgaagcccaagggcctgggtcagacaaagaacctgattggtatctaccgcctttgcctgaccagcaagacc

SEQ ID NO: 1452 - DNA, 201 bp, Homo sapiens
gtggcagtggaggccgactgccgggacacaggcactccgccttcgtgcccacccgctcctacccagaggagggtctggaaatgcaccccttggagcgtcgrggggggcaccaccgcccagacagctccaccctccacacggatgatggctacatgcccatgtccccaggggtggccccagtgcccagtggccgaaagggca

SEQ ID NO: 1453 - DNA, 201 bp, Homo sapiens
tgggcctcaaggggcagcagagctggctgcccactcgtccctgctggggggcccacaaggacctgggggcatgagcgccttcacccgggtgaacctcagtyctaaccgcaaccagagtgccaaagtgatccgtgcagacccacaagggtgccggcggaggcatagctccgagactttctcctcaacacccagtgccacccg

SEQ ID NO: 1454 - DNA, 201 bp, Homo sapiens
ggggccaccactctcatgtcttgcctcaccccaaacccccagtggagagcagcggtggtaagctcttaccttgcacaggtgactacatgaacatgtcaccmgtgggggactccaacaccagcagcccctccgactgctactacggccctgaggacccccagcacaagccagtcctctcctactactcattgccaagatcct

SEQ ID NO: 1455 - DNA, 201 bp, Homo sapiens
ccgctcctacccagaggagggtctggaaatgcaccccttggagcgtcggggggggcaccaccgcccagacagctccaccctccacacggatgatggctacrtgcccatgtccccaggggtggccccagtgcccagtggccgaaagggcagtggagactatatgcccatgagccccaagagcgtatctgccccacagcagat

SEQ ID NO: 1456 - DNA, 201 bp, Homo sapiens
tgggaggaggcgaaggaggagggagaaccccgtgcaacgttgggacttggcaacccgcctccccctgcccaaggatatttaatttgcctcgggaatcgctrcttccagaggggaactcaggagggaaggcgcgcgcgcgcgcgcgctcctggaggggcaccgcagggacccccgactgtcgcctccctgtgccggactcca

SEQ ID NO: 1457 - DNA, 201 bp, Homo sapiens
gtggacacctcgccagctgcccctgtaagctatgctgacatgcgaacaggcattgctgcagaggaggtgagcctgcccagggccaccatggctgctgcctyctcatcctcagcagcctctgcttccccgactgggcctcaaggggcagcagagctggctgcccactcgtccctgctggggggcccacaaggacctgggggc

SEQ ID NO: 1458 - DNA, 201 bp, Homo sapiens
agcccaagagcccgggggaatatgtcaatattgaatttgggagtgatcagtctggctacttgtctggcccggtggctttccacagctcaccttctgtcagrtgtccatcccagctccagccagctcccagagaggaagagactggcactgaggagtacatgaagatggacctggggccgggccggagggcagcctggcagg

SEQ ID NO: 1459 - DNA, 201 bp, Homo sapiens
ccccaacggtcactacattttgtctcggggtggcaatggccaccgctgcaccccaggaacaggcttgggcacgagtccagccttggctggggatgaagcasccagtgctgcagatctggataatcggttccgaaagagaactcactcggcaggcacatcccctaccattacccaccagaagaccccgtcccagtcctcagt

SEQ ID NO: 1460 - DNA, 201 bp, Homo sapiens
tttctcctcaacacccagtgccacccgggtgggcaacacagtgccctttggagcgggggcagcagtagggggcggtggcggtagcagcagcagcagcgagratgtgaaacgccacagctctgcttcctttgagaatgtgtggctgaggcctggggagcttgggggagcccccaaggagccagccaaactgtgtggggctgc

SEQ ID NO: 1461 - DNA, 201 bp, Homo sapiens
cacgaggctgtccctgggggatcccaaggccagcaccttacctcgggcccgagagcagcagcagcagcagcagcccttgctgcaccctccagagcccaagrgcccgggggaatatgtcaatattgaatttgggagtgatcagtctggctacttgtctggcccggtggctttccacagctcaccttctgtcaggtgtccatc

SEQ ID NO: 1462 - DNA, 201 bp, Homo sapiens
tgcggggctaggctggagcccagccttccacatccccaccatcaggttctgcagccccatctgcctcgaaaggtggacacagctgctcagaccaatagcckcctggcccggcccacgaggctgtccctgggggatcccaaggccagcaccttacctcgggcccgagagcagcagcagcagcagcagcccttgctgcaccct

SEQ ID NO: 1463 - DNA, 201 bp, Homo sapiens
gtaagctatgctgacatgcgaacaggcattgctgcagaggaggtgagcctgcccagggccaccatggctgctgcctcctcatcctcagcagcctctgcttmcccgactgggcctcaaggggcagcagagctggctgcccactcgtccctgctggggggcccacaaggacctgggggcatgagcgccttcacccgggtgaac

SEQ ID NO: 1464 - DNA, 201 bp, Homo sapiens
cggtcagtctgtcgtccagtagcaccagtggccatggctccacctcggattgtctcttcccacggcgatctagtgcttcggtgtctggttcccccagcgayggcggtttcatctcctcggatgagtatggctccagtccctgcgatttccggagttccttccgcagtgtcactccggattccctgggccacaccccaccag

SEQ ID NO: 1465 - DNA, 201 bp, Homo sapiens
gggctcagcagctgcgtcctccttcagctgcccctccccggcgcggggggcggcgtggatttcagagtcggggtttctgctgcctccagccctgtttgcaygtgccgggccgcggcgaggagcctccgccccccacccggttgtttttcggagcctccctctgctcagcgttggtggtggcggtggcagcatggcgagccc

SEQ ID NO: 1466 - DNA, 201 bp, Homo sapiens
ggacttcaaacagtgccctcaggagtgcacccctgaaccgcagcctcccccacccccaccccctcatcaacccctgggcagcggtgagagcagctccaccygccgctcaagtgaggatttaagcgcctatgccagcatcagtttccagaagcagccagaggaccgtcagtagctcaactggacatcacagcagaatttcgc

SEQ ID NO: 1467 - DNA, 201 bp, Homo sapiens
caccatgtcccgcccagcctcggtggacggcagccctgtgagtcccagcaccaacagaacccacgcccaccggcatcggggcagcgcccggctgcaccccscgctcaaccacagccgctccatccccatgccggcttcccgctgctcgccttcggccaccagcccggtcagtctgtcgtccagtagcaccagtggccatgg

SEQ ID NO: 1468 - DNA, 201 bp, Homo sapiens
tggagcgtcggggggggcaccaccgcccagacagctccaccctccacacggatgatggctacatgcccatgtccccaggggtggccccagtgcccagtggycgaaagggcagtggagactatatgcccatgagccccaagagcgtatctgccccacagcagatcatcaatcccatcagacgccatccccagagagtggacc

SEQ ID NO: 1469 - DNA, 201 bp, Homo sapiens
ctctcctacagctgcacaaccgtgctaagggccaccacgacggagctgcggccctcggggcgggaggtggtgggggcagctgcagcggcagctccggcctyggtgaggctggggaggacttgagctacggtgacgtgcccccaggacccgcattcaaagaggtctggcaagtgatcctgaagcccaagggcctgggtcaga

SEQ ID NO: 1470 - DNA, 201 bp, Homo sapiens
gcagtagggggcggtggcggtagcagcagcagcagcgaggatgtgaaacgccacagctctgcttcctttgagaatgtgtggctgaggcctggggagcttgrgggagcccccaaggagccagccaaactgtgtggggctgctgggggtttggagaatggtcttaactacatagacctggatttggtcaaggacttcaaacag

SEQ ID NO: 1471 - DNA, 201 bp, Homo sapiens
ccggcatcagcacctccgcctttccactagctctggtcgccttctctatgctgcaacagcagatgattcttcctcttccaccagcagcgacagcctgggtsggggatactgcggggctaggctggagcccagccttccacatccccaccatcaggttctgcagccccatctgcctcgaaaggtggacacagctgctcagac

SEQ ID NO: 1472 - DNA, 201 bp, Homo sapiens
ttaagcacacccagcgccccggggagccggaggagggtgcccggcatcagcacctccgcctttccactagctctggtcgccttctctatgctgcaacagcrgatgattcttcctcttccaccagcagcgacagcctgggtgggggatactgcggggctaggctggagcccagccttccacatccccaccatcaggttctgc

SEQ ID NO: 1473 - DNA, 201 bp, Homo sapiens
acaaagaacctgattggtatctaccgcctttgcctgaccagcaagaccatcagcttcgtgaagctgaactcggaggcagcggccgtggtgctgcagctgaygaacatcaggcgctgtggccactcggaaaacttcttcttcatcgaggtgggccgttctgccgtgacggggcccggggagttctggatgcaggtggatgac

SEQ ID NO: 1474 - DNA, 201 bp, Homo sapiens
gccttcgtgcccacccgctcctacccagaggagggtctggaaatgcaccccttggagcgtcggggggggcaccaccgcccagacagctccaccctccacasggatgatggctacatgcccatgtccccaggggtggccccagtgcccagtggccgaaagggcagtggagactatatgcccatgagccccaagagcgtatct

SEQ ID NO: 1475 - DNA, 201 bp, Homo sapiens
ccgccgctcaagtgaggatttaagcgcctatgccagcatcagtttccagaagcagccagaggaccgtcagtagctcaactggacatcacagcagaatttckcagtacttgtggcccactctctgcagagagtaaattgagagcccaagaagcagggcaaaaagagcctctcagactcggtcatagcagccctgccaccttt

SEQ ID NO: 1476 - DNA, 201 bp, Homo sapiens
gatttaagcgcctatgccagcatcagtttccagaagcagccagaggaccgtcagtagctcaactggacatcacagcagaatttcgcagtacttgtggcccrctctctgcagagagtaaattgagagcccaagaagcagggcaaaaagagcctctcagactcggtcatagcagccctgccacctttacctggcatcaaattt

SEQ ID NO: 1477 - DNA, 201 bp, Homo sapiens; identical to SEQ ID NO: 1439

SEQ ID NO: 1478 - DNA, 201 bp, Homo sapiens; identical to SEQ ID NO: 1440

SEQ ID NO: 1479 - DNA, 201 bp, Homo sapiens; identical to SEQ ID NO: 1441

SEQ ID NO: 1480 - DNA, 201 bp, Homo sapiens; identical to SEQ ID NO: 1442

SEQ ID NO: 1481 - DNA, 201 bp, Homo sapiens; identical to SEQ ID NO: 1443

SEQ ID NO: 1482 - DNA, 201 bp, Homo sapiens; identical to SEQ ID NO: 1444

SEQ ID NO: 1483 - DNA, 201 bp, Homo sapiens; identical to SEQ ID NO: 1445

SEQ ID NO: 1484 - DNA, 201 bp, Homo sapiens; identical to SEQ ID NO: 1446

SEQ ID NO: 1485 - DNA, 201 bp, Homo sapiens; identical to SEQ ID NO: 1447

SEQ ID NO: 1486 - DNA, 201 bp, Homo sapiens; identical to SEQ ID NO: 1448

SEQ ID NO: 1487 - DNA, 201 bp, Homo sapiens; identical to SEQ ID NO: 1449

SEQ ID NO: 1488 - DNA, 201 bp, Homo sapiens; identical to SEQ ID NO: 1450

SEQ ID NO: 1489 - DNA, 201 bp, Homo sapiens; identical to SEQ ID NO: 1451

SEQ ID NO: 1490 - DNA, 201 bp, Homo sapiens; identical to SEQ ID NO: 1452

SEQ ID NO: 1491 - DNA, 201 bp, Homo sapiens; identical to SEQ ID NO: 1453

SEQ ID NO: 1492 - DNA, 201 bp, Homo sapiens; identical to SEQ ID NO: 1454

SEQ ID NO: 1493 - DNA, 201 bp, Homo sapiens; identical to SEQ ID NO: 1455

SEQ ID NO: 1494 - DNA, 201 bp, Homo sapiens; identical to SEQ ID NO: 1456

SEQ ID NO: 1495 - DNA, 201 bp, Homo sapiens; identical to SEQ ID NO: 1457

SEQ ID NO: 1496 - DNA, 201 bp, Homo sapiens; identical to SEQ ID NO: 1458

SEQ ID NO: 1497 - DNA, 201 bp, Homo sapiens; identical to SEQ ID NO: 1459

SEQ ID NO: 1498 - DNA, 201 bp, Homo sapiens; identical to SEQ ID NO: 1460

SEQ ID NO: 1499 - DNA, 201 bp, Homo sapiens; identical to SEQ ID NO: 1461

SEQ ID NO: 1500 - DNA, 201 bp, Homo sapiens; identical to SEQ ID NO: 1462

SEQ ID NO: 1501 - DNA, 201 bp, Homo sapiens; identical to SEQ ID NO: 1463

SEQ ID NO: 1502 - DNA, 201 bp, Homo sapiens; identical to SEQ ID NO: 1464

SEQ ID NO: 1503 - DNA, 201 bp, Homo sapiens; identical to SEQ ID NO: 1465

SEQ ID NO: 1504 - DNA, 201 bp, Homo sapiens
ggacttcaaacagtgccctcaggagtgcacccctgaaccgcagcctcccccacccccaccccctcatcaacccctgggcagcggtgagagcagctccaccygccgctcaagtgaggatttaagcgcctatgccagcatcagtttccagaagcagccagaggaccgtcagtagctcaactggacatcacagcagaatgaaga

SEQ ID NO: 1505 - DNA, 201 bp, Homo sapiens; identical to SEQ ID NO: 1467

SEQ ID NO: 1506 - DNA, 201 bp, Homo sapiens; identical to SEQ ID NO: 1468

SEQ ID NO: 1507 - DNA, 201 bp, Homo sapiens; identical to SEQ ID NO: 1469

SEQ ID NO: 1508 - DNA, 201 bp, Homo sapiens; identical to SEQ ID NO: 1470

SEQ ID NO: 1509 - DNA, 201 bp, Homo sapiens; identical to SEQ ID NO: 1471

SEQ ID NO: 1510 - DNA, 201 bp, Homo sapiens; identical to SEQ ID NO: 1472

SEQ ID NO: 1511 - DNA, 201 bp, Homo sapiens; identical to SEQ ID NO: 1473

SEQ ID NO: 1512 - DNA, 201 bp, Homo sapiens; identical to SEQ ID NO: 1474

SEQ ID NO: 1513 - DNA, 201 bp, Homo sapiens
tggacatcacagcagaatgaagacctaaatgacctcagcaaatcctcttctaactcatgggtacccagactctaaatatttcatgattcacaactaggacytcatatcttcctcatcagtagatggtacgatgcatccatttcagtttgtttactttatccaatcctcaggatttcattgactgaactgcacgttctatat

SEQ ID NO: 1514 - DNA, 201 bp, Homo sapiens
aatgcttaaaacaaggcttaaaagagtagaatagggtatgatccttgttttaagattgtaattcagaaaacataatataagaatcatagtgccatagatgkttctcaattgtatagttatatttgctgatactatctcttgtcatataaacctgatgttgagctgagttccttataagaattaatcttaattttgtatttt

SEQ ID NO: 1515 - DNA, 201 bp, Homo sapiens
aagttcactgatcctggaatggggaacctcacctacagcaacccctcctaccgaacatccacacaggaagtgaagattgaagcaatccccaaaccagccawgtacaaccagctgtgctataagaaagagggagggcctgaccataactacaccaaggagaagatcaagatcgtagagggaatctgcctcctgtctggggat

SEQ ID NO: 1516 - DNA, 201 bp, Homo sapiens
tactacctacctgttcccctcttgactttcactgtgacaatggcaagtgcatccgccgctcctgggtgtgtgacggggacaacgactgtgaggatgactcrgatgagcaggactgtcccccccgggagtgtgaggaggacgagtttccctgccagaatggctactgcatccggagtctgtggcactgcgatggtgacaatg

SEQ ID NO: 1517 - DNA, 201 bp, Homo sapiens
gggaccaatgcctgtggtgtgaacaatggtggctgcacccacctctgctttgccagagcctcggacttcgtatgtgcctgtcctgacgaacctgatagccrgccctgctcccttgtgcctggcctggtaccaccagctcctagggctactggcatgagtgaaaagagcccagtgctacccaacacaccacctaccaccttg

SEQ ID NO: 1518 - DNA, 201 bp, Homo sapiens
cgggccatcgtactgtaccatgagatggggtttatgtactggacagactggggggagaatgccaagttagagcggtccggaatggatggctcagaccgcgyggtgctcatcaacaacaacctaggatggcccaatggactgactgtggacaaggccagctcccaactgctatgggccgatgcccacaccgagcgaattgag

SEQ ID NO: 1519 - DNA, 201 bp, Homo sapiens
catcttcgccaggaggatagacattcgcatggtctccctggacatcccttattttgctgatgtggtggtaccaatcaacattaccatgaagaacaccattrccgttggagtagacccccaggaaggaaaggtgtactggtctgacagcacactgcacaggatcagtcgtgccaatctggatggctcacagcatgaggacat

SEQ ID NO: 1520 - DNA, 201 bp, Homo sapiens
ctgaagaccactgacgggctggcagtggactgggtggccaggaacctgtactggacagacacaggtcgaaataccattgaggcgtccaggctggatggttyctgccgcaaagtactgatcaacaatagcctggatgagccccgggccattgctgttttccccaggaaggggtacctcttctggacagactggggccacatt

SEQ ID NO: 1521 - DNA, 201 bp, Homo sapiens
cctaatggacatccatgtcttccaccgccgccggcccccagtgtctacaccatgtgctatggagaatggcggctgtagccacctgtgtcttaggtccccaratccaagcggattcagctgtacctgccccacaggcatcaacctgctgtctgatggcaagacctgctcaccaggcatgaacagtttcctcatcttcgccag

SEQ ID NO: 1522 - DNA, 201 bp, Homo sapiens
ctggcagcaatgtcatcctcgtgaggtccaacctgccaggcctcatggacatgcaggctgtggaccgggcacagccactaggttttaacaagtgcggctcragaaatggcggctgctcccacctctgcttgcctcggccttctggcttctcctgtgcctgccccactggcatccagctgaagggagatgggaagacctgtg

SEQ ID NO: 1523 - DNA, 201 bp, Homo sapiens
atatcatcgtggtttcccctcagcggcagacagggaccaatgcctgtggtgtgaacaatggtggctgcacccacctctgctttgccagagcctcggacttygtatgtgcctgtcctgacgaacctgatagccagccctgctcccttgtgcctggcctggtaccaccagctcctagggctactggcatgagtgaaaagagcc

SEQ ID NO: 1524 - DNA, 201 bp, Homo sapiens
taccctggactatgatacccgcaggatctactgggtggatgcgcatctggaccggatcgagagtgctgacctcaatgggaaactgcggcaggtcttggtcrgccatgtgtcccacccctttgccctcacacagcaagacaggtggatctactggacagactggcagaccaagtcaatccagcgtgttgacaaatactcagg

SEQ ID NO: 1525 - DNA, 201 bp, Homo sapiens
cgatgaagagaactgtgagaatacaggaagcccccaatgtgccttggaccagttcctgtgttggaatgggcgctgcattgggcagaggaagctgtgcaacrgggtcaacgactgtggtgacaacagcgacgaaagcccacagcagaattgccggccccggacgggtgaggagaactgcaatgttaacaacggtggctgtgc

SEQ ID NO: 1526 - DNA, 181 bp, Homo sapiens
ccaggcctggccagcagccccgagtgtgcttgtggtcggagccacttcacatgtgcagtgagtgctcttggagagtgtacstgcatccctgcccagtggcagtgtgatggagacaatgactgcggggaccacagcgatgaggatggatgtatactacctacctgttcccctcttgactttc

SEQ ID NO: 1527 - DNA, 201 bp, Homo sapiens
ctgggctggagagcccagggggcctggctgtggattgggtccatgacaaactctactggaccgactcaggcacctcgaggattgaggtggccaatctggayggggcccaccggaaggtgttgctgtggcagaacctggagaagccccgggccattgccttgcatcccatggagggtaccatttactggacagactggggca

SEQ ID NO: 1528 - DNA, 201 bp, Homo sapiens
cctcgaggattgaggtggccaatctggacggggcccaccggaaggtgttgctgtggcagaacctggagaagccccgggccattgccttgcatcccatggarggtaccatttactggacagactggggcaacaccccccgtattgaggcctccagcatggatggctctggacgccgcatcattgccgatacccatctcttct

SEQ ID NO: 1529 - DNA, 201 bp, Homo sapiens
acaacctggagaatgccattgcccttgatttccaccaccgccgcgagcttgtcttctggtcagatgtcaccctggaccggatcctccgtgccaacctcaayggcagcaacgtggaggaggttgtgtctactgggctggagagcccagggggcctggctgtggattgggtccatgacaaactctactggaccgactcaggca

SEQ ID NO: 1530 - DNA, 201 bp, Homo sapiens
tcatcgtggtttcccctcagcggcagacagggaccaatgcctgtggtgtgaacaatggtggctgcacccacctctgctttgccagagcctcggacttcgtrtgtgcctgtcctgacgaacctgatagccagccctgctcccttgtgcctggcctggtaccaccagctcctagggctactggcatgagtgaaaagagcccag

SEQ ID NO: 1531 - DNA, 201 bp, Homo sapiens
gctcatcaacaacaacctaggatggcccaatggactgactgtggacaaggccagctcccaactgctatgggccgatgcccacaccgagcgaattgaggctrctgacctgaatggtgccaatcggcatacattggtgtcaccggtgcagcacccatatggcctcaccctgctcgactcctatatctactggactgactggca

SEQ ID NO: 1532 - DNA, 201 bp, Homo sapiens
cagggggcctggctgtggattgggtccatgacaaactctactggaccgactcaggcacctcgaggattgaggtggccaatctggacggggcccaccggaargtgttgctgtggcagaacctggagaagccccgggccattgccttgcatcccatggagggtaccatttactggacagactggggcaacaccccccgtattg

SEQ ID NO: 1533 - DNA, 201 bp, Homo sapiens
cgctgtgtccgcctgtcctggcgctgtgatggggaggacgactgtgcagacaacagcgatgaagagaactgtgagaatacaggaagcccccaatgtgcctyggaccagttcctgtgttggaatgggcgctgcattgggcagaggaagctgtgcaacggggtcaacgactgtggtgacaacagcgacgaaagcccacagcag

SEQ ID NO: 1534 - DNA, 201 bp, Homo sapiens
cacaggatcagtcgtgccaatctggatggctcacagcatgaggacatcatcaccacagggctacagaccacagatgggctcgcggttgatgccattggccrgaaagtatactggacagacacgggaacaaaccggattgaagtgggcaacctggacgggtccatgcggaaagtgttggtgtggcagaaccttgacagtccc

SEQ ID NO: 1535 - DNA, 201 bp, Homo sapiens
gaccaagagcatacagagcgctgaccggctgacagggctggaccgggagactctgcaggagaacctggaaaacctaatggacatccatgtcttccaccgcygccggcccccagtgtctacaccatgtgctatggagaatggcggctgtagccacctgtgtcttaggtccccaaatccaagcggattcagctgtacctgccc

SEQ ID NO: 1536 - DNA, 201 bp, Homo sapiens
aggtggccaatctggacggggcccaccggaaggtgttgctgtggcagaacctggagaagccccgggccattgccttgcatcccatggagggtaccatttaytggacagactggggcaacaccccccgtattgaggcctccagcatggatggctctggacgccgcatcattgccgatacccatctcttctggcccaatggcc

SEQ ID NO: 1537 - DNA, 201 bp, Homo sapiens
gtagtgacggaagctgcattgctgagcattggtactgcgacggtgacaccgactgcaaagatggctccgatgaggagaactgtcccacctccatgtgtacrgcagaacagttccgctgtcactcaggccgctgtgtccgcctgtcctggcgctgtgatggggaggacgactgtgcagacaacagcgatgaagagaactgtg

SEQ ID NO: 1538 - DNA, 201 bp, Homo sapiens
atacccgcaggatctactgggtggatgcgcatctggaccggatcgagagtgctgacctcaatgggaaactgcggcaggtcttggtcggccatgtgtcccayccctttgccctcacacagcaagacaggtggatctactggacagactggcagaccaagtcaatccagcgtgttgacaaatactcaggccggaacaaggaga

SEQ ID NO: 1539 - DNA, 201 bp, Homo sapiens
cctgaatggtgccaatcggcatacattggtgtcaccggtgcagcacccatatggcctcaccctgctcgactcctatatctactggactgactggcagactmggagcatccaccgtgctgacaagggtactggcagcaatgtcatcctcgtgaggtccaacctgccaggcctcatggacatgcaggctgtggaccgggcaca

SEQ ID NO: 1540 - DNA, 201 bp, Homo sapiens
tgtgggtaaagacagggatgaaggatagaggctgagagaagaaggaagaatcagcccagcaggtatgggcatctgggaaacctccagcctcaagtgtgttrgtaacatgaaaaagctctggggggtagttggatctgggtgtctggtccattgctggcagtggacattattcttgccctaagagacactgccttttcagca

SEQ ID NO: 1541 - DNA, 201 bp, Homo sapiens
atgaaggatagaggctgagagaagaaggaagaatcagcccagcaggtatgggcatctgggaaacctccagcctcaagtgtgttggtaacatgaaaaagctytggggggtagttggatctgggtgtctggtccattgctggcagtggacattattcttgccctaagagacactgccttttcagcagcagatactggtgagat

SEQ ID NO: 1542 - DNA, 201 bp, Homo sapiens
cctgacccctctctccctcatgtcctgggattctggggaagagacctagaaacaagctttcaaagaaaaaccagaagttgtcataaatggtcagaaagaaygatcaggttggagacttgggaaacccagggcctaaagagaagtatccatgagggtcaaacttcctgttgaacttcctatgttctttctcaagtgctcagg

SEQ ID NO: 1543 - DNA, 201 bp, Homo sapiens
ttcctatgttctttctcaagtgctcagggatctaagttagtggacagcaagcctgtggctacggggtggtgatgttcctcttccagctgtcccctcagctraggggcttagtttccatgtgggatgccatcacttggttcatgctcattcacacaaagggcacgtgtctcagcctggtatcagggaaattgagacttattt

SEQ ID NO: 1544 - DNA, 201 bp, Homo sapiens
ccttagccttgctctcagtagcgtcagccccagttctgagcctccccacattacacttaacaagcagtaaaggagtgagcactttgggtccttagactcaygtctggggaggaagagcaagtagaaaagtggcattttcttgattggaaagggggaaggatcttattgcacttgggctgttcagaatgtagaaaggacata

SEQ ID NO: 1545 - DNA, 201 bp, Homo sapiens
ccacattacacttaacaagcagtaaaggagtgagcactttgggtccttagactcatgtctggggaggaagagcaagtagaaaagtggcattttcttgattrgaaagggggaaggatcttattgcacttgggctgttcagaatgtagaaaggacatatttgaggaagtatctatttgagcactgatttactctgtaaaaagc

SEQ ID NO: 1546 - DNA, 201 bp, Homo sapiens
aggacatatttgaggaagtatctatttgagcactgatttactctgtaaaaagcaaaatctctctgtcctaaactaatggaagcgattctcccatgctcatktgtaatggttttaacgttactcactggagagattggactttctggagttatttaaccactatgttcagtattttaggactttatgataatttaatataaa

SEQ ID NO: 1547 - DNA, 201 bp, Homo sapiens
tggttttaacgttactcactggagagattggactttctggagttatttaaccactatgttcagtattttaggactttatgataatttaatataaatttagsttttcttaatcaccttgcctggcttggagtcatgactaatcctgcacctgctctgtctggcagacccatgctgtggaaaacctgcttacagacatcactt

SEQ ID NO: 1548 - DNA, 201 bp, Homo sapiens; identical to SEQ ID NO: 1515

SEQ ID NO: 1549 - DNA, 201 bp, Homo sapiens; identical to SEQ ID NO: 1516

SEQ ID NO: 1550 - DNA, 201 bp, Homo sapiens; identical to SEQ ID NO: 1517

SEQ ID NO: 1551 - DNA, 201 bp, Homo sapiens; identical to SEQ ID NO: 1518

SEQ ID NO: 1552 - DNA, 201 bp, Homo sapiens; identical to SEQ ID NO: 1519

SEQ ID NO: 1553 - DNA, 201 bp, Homo sapiens; identical to SEQ ID NO: 1520

SEQ ID NO: 1554 - DNA, 201 bp, Homo sapiens; identical to SEQ ID NO: 1521

SEQ ID NO: 1555 - DNA, 201 bp, Homo sapiens; identical to SEQ ID NO: 1522

SEQ ID NO: 1556 - DNA, 201 bp, Homo sapiens; identical to SEQ ID NO: 1523

SEQ ID NO: 1557 - DNA, 201 bp, Homo sapiens; identical to SEQ ID NO: 1524

SEQ ID NO: 1558 - DNA, 201 bp, Homo sapiens; identical to SEQ ID NO: 1525

SEQ ID NO: 1559 - DNA, 177 bp, Homo sapiens
gcctggccagcagccccgagtgtgcttgtggtcggagccacttcacatgtgcagtgagtgctcttggagagtgtacstgcatccctgcccagtggcagtgtgatggagacaatgactgcggggaccacagcgatgaggatggatgtatactacctacctgttcccctcttgactttc

SEQ ID NO: 1560 - DNA, 201 bp, Homo sapiens; identical to SEQ ID NO: 1527

SEQ ID NO: 1561 - DNA, 201 bp, Homo sapiens; identical to SEQ ID NO: 1528

SEQ ID NO: 1562 - DNA, 201 bp, Homo sapiens; identical to SEQ ID NO: 1529

SEQ ID NO: 1563 - DNA, 201 bp, Homo sapiens; identical to SEQ ID NO: 1530

SEQ ID NO: 1564 - DNA, 201 bp, Homo sapiens; identical to SEQ ID NO: 1531

SEQ ID NO: 1565 - DNA, 201 bp, Homo sapiens; identical to SEQ ID NO: 1532

SEQ ID NO: 1566 - DNA, 201 bp, Homo sapiens; identical to SEQ ID NO: 1533

SEQ ID NO: 1567 - DNA, 201 bp, Homo sapiens; identical to SEQ ID NO: 1534

SEQ ID NO: 1568 - DNA, 201 bp, Homo sapiens; identical to SEQ ID NO: 1535

SEQ ID NO: 1569 - DNA, 201 bp, Homo sapiens; identical to SEQ ID NO: 1536

SEQ ID NO: 1570 - DNA, 201 bp, Homo sapiens; identical to SEQ ID NO: 1537

SEQ ID NO: 1571 - DNA, 201 bp, Homo sapiens; identical to SEQ ID NO: 1538

SEQ ID NO: 1572 - DNA, 201 bp, Homo sapiens; identical to SEQ ID NO: 1539

SEQ ID NO: 1573 - DNA, 201 bp, Homo sapiens
atgcagtttctgggggatgaagagatggtacgcaaagccatggaagctgtggctgcccagggcaaggccaagaagtgaaggccagcagggaggatactgtycccaggagcaccctccctgcctgtcttgtccctctgcccctcccacctgcacatgtcacactgaccccatctgtagacatcttgagttgtagctgcagat

SEQ ID NO: 1574 - DNA, 201 bp, Homo sapiens
ccaagaagtgaaggccagcagggaggatactgtccccaggagcaccctccctgcctgtcttgtccctctgcccctcccacctgcacatgtcacactgaccmcatctgtagacatcttgagttgtagctgcagatggggaccagtgactcccattttcattttagccattttgtctcctgcacccactcccttcatacaatc

SEQ ID NO: 1575 - DNA, 201 bp, Homo sapiens
cctgagggctctagtcattccagtggaagatgaatgtaacctgcatggtgatgtgacaactgtttcctccctgacgccagaggagctggctctagaaggttgggatcaatcctgaatttagttatgtgttacatttaatttaagaagtatagtatatataaataatacaaaacaataacccttctggggtttctcgtggcg

SEQ ID NO: 1576 - DNA, 201 bp, Homo sapiens
tgacaactgtttcctccctgacgccagaggagctggctctagaaggttgggatcaatcctgaatttagttatgtgttacatttaatttaagaagtatagtrtatataaataatacaaaacaataacccttctggggtttctcgtggcggttgaaatagtcccacatgtagtcatcagaaaataagccattcctcataccaa

SEQ ID NO: 1577 - DNA, 201 bp, Homo sapiens
tgggatcaatcctgaatttagttatgtgttacatttaatttaagaagtatagtatatataaataatacaaaacaataacccttctggggtttctcgtggcrgttgaaatagtcccacatgtagtcatcagaaaataagccattcctcataccaatataggatcagctccttgacctctgaggggcaggagtgcttcctggt

SEQ ID NO: 1578 - DNA, 201 bp, Homo sapiens
ttatgtgttacatttaatttaagaagtatagtatatataaataatacaaaacaataacccttctggggtttctcgtggcggttgaaatagtcccacatgtrgtcatcagaaaataagccattcctcataccaatataggatcagctccttgacctctgaggggcaggagtgcttcctggtgtgggtattacaatcccttcc

SEQ ID NO: 1579 - DNA, 201 bp, Homo sapiens
aacccttctggggtttctcgtggcggttgaaatagtcccacatgtagtcatcagaaaataagccattcctcataccaatataggatcagctccttgacctytgaggggcaggagtgcttcctggtgtgggtattacaatcccttcctgccttgtttcgtgacagtgaaatgcctcttggtcctgtccaagtatgtctttca

SEQ ID NO: 1580 - DNA, 201 bp, Homo sapiens
ccaatataggatcagctccttgacctctgaggggcaggagtgcttcctggtgtgggtattacaatcccttcctgccttgtttcgtgacagtgaaatgcctyttggtcctgtccaagtatgtctttcactgatttctgaatcatgttctacttgcttggccctgccacatgggtccagtgttcatctgagcataactgtact

SEQ ID NO: 1581 - DNA, 201 bp, Homo sapiens
caggagtgcttcctggtgtgggtattacaatcccttcctgccttgtttcgtgacagtgaaatgcctcttggtcctgtccaagtatgtctttcactgatttytgaatcatgttctacttgcttggccctgccacatgggtccagtgttcatctgagcataactgtactaaatctttttccagatcagtataataaaggagtg

SEQ ID NO: 1582 - DNA, 201 bp, Homo sapiens
gacagctcctccagcttactgtcccttaagttcaggtcggaggagcggccggtgaagaagcgcaaggtgcagagctgccacctgcagaagaagcagctgckgctgctggaggccatggtggaggagcagcgccggctgagccgcgccgtggaggagacctgccgcgaggtgcgccgtgtgctggaccagcagcacatcctg

SEQ ID NO: 1583 - DNA, 201 bp, Homo sapiens
gggccgatccgcctgggcggcggtgagaggcagggccgggagccgggccgctgggtttgggcctggcccgctcgccgcaatattgatggcccgtcagtgcrgccctgattcctgtgctttcagttaaaaggtttctgttgttgtagcttatgcagttgctctgttgctatggaaacgtgacatcaaaatgacgtttcccgt

SEQ ID NO: 1584 - DNA, 201 bp, Homo sapiens
cctgcagctgcaggagcgcatgatgagtctgctggagaggatcatcaccaagtccagcgtctaggccagcaggcggcggcggcggcggggccgggcggctrgtggtactgctcaggccacccagggcaggccactcaggccaggcgggcaagggggccgccccgcgagcggagaccgccttccacctggcctctggcagga

SEQ ID NO: 1585 - DNA, 201 bp, Homo sapiens
ggacagccagccgccggggccctccacgtcccagaccgaggcgtccctgtcgccgcccgctaagtccacccctctgtacttcccgtataaccagtgctccyacgaaggccgcttcgaggatgatcgctccgacagctcctccagcttactgtcccttaagttcaggtcggaggagcggccggtgaagaagcgcaaggtgca

SEQ ID NO: 1586 - DNA, 201 bp, Homo sapiens
gcaggcggcggcggcggcggggccgggcggctggtggtactgctcaggccacccagggcaggccactcaggccaggcgggcaagggggccgccccgcgagyggagaccgccttccacctggcctctggcaggatgtcccttctgaggggtattttgaggaacccccaggccctggggaccgtgaggctccagtctccagca

SEQ ID NO: 1587 - DNA, 201 bp, Homo sapiens
gccacctgcagaagaagcagctgcggctgctggaggccatggtggaggagcagcgccggctgagccgcgccgtggaggagacctgccgcgaggtgcgccgygtgctggaccagcagcacatcctgcaggtgcagagcctgcagctgcaggagcgcatgatgagtctgctggagaggatcatcaccaagtccagcgtctagg

SEQ ID NO: 1588 - DNA, 201 bp, Homo sapiens
tccttgcctgttcccacccgaggccccctcttggcctgcgtgagccggggcggcactgaactgggggccgatccgcctgggcggcggtgagaggcagggcygggagccgggccgctgggtttgggcctggcccgctcgccgcaatattgatggcccgtcagtgcggccctgattcctgtgctttcagttaaaaggtttctg

SEQ ID NO: 1589 - DNA, 201 bp, Homo sapiens
ctggcaggatgtcccttctgaggggtattttgaggaacccccaggccctggggaccgtgaggctccagtctccagcatgaatgcccttcctcggacacagrccagggcctctggggttcactccgagtaagaacgtcctagagccactctccagtgtcgttactatcaatgatacttgacgtggctttgatattaaacgta

SEQ ID NO: 1590 - DNA, 201 bp, Homo sapiens
gaacccccaggccctggggaccgtgaggctccagtctccagcatgaatgcccttcctcggacacaggccagggcctctggggttcactccgagtaagaacrtcctagagccactctccagtgtcgttactatcaatgatacttgacgtggctttgatattaaacgtatactttttcattcttgcctggaacgcacagtttg

SEQ ID NO: 1591 - DNA, 201 bp, Homo sapiens
aacccccaggccctggggaccgtgaggctccagtctccagcatgaatgcccttcctcggacacaggccagggcctctggggttcactccgagtaagaacgrcctagagccactctccagtgtcgttactatcaatgatacttgacgtggctttgatattaaacgtatactttttcattcttgcctggaacgcacagtttgc

SEQ ID NO: 1592 - DNA, 201 bp, Homo sapiens
ctccagtctccagcatgaatgcccttcctcggacacaggccagggcctctggggttcactccgagtaagaacgtcctagagccactctccagtgtcgttastatcaatgatacttgacgtggctttgatattaaacgtatactttttcattcttgcctggaacgcacagtttgctgttgctggcttggtgaggatgccctg

SEQ ID NO: 1593 - DNA, 200 bp, Homo sapiens
agctgggggagctctctcctgaagggaaccctgtgtcctccctcaccaggacctctgcgtctctccttaaatggcctctgacgcctgatgaaaaccccagsgaccttccaggaggcttttattcagctctgtttggagcatcaggtgtttccactgcctccttagcaatgacactaataaaagtcgtaacacctgttcac

SEQ ID NO: 1594 - DNA, 115 bp, Homo sapiens
tgatgaaaaccccagcgaccttccaggaggcttttattcagctctgtttggagcatcaggtgtttccactgcctccttagcaatgacactaataaaagtcrtaacacctgttcac

SEQ ID NO: 1595 - DNA, 201 bp, Homo sapiens
gccttctactgccatggggactgcccctttccactggctgaccacctcaactcaaccaaccatgccattgtgcagaccctggtcaattctgtcaattccastatccccaaagcctgttgtgtgcccactgaactgagtgccatctccatgctgtacctggatgagtatgataaggtggtactgaaaaattatcaggagatg

SEQ ID NO: 1596 - DNA, 201 bp, Homo sapiens
gaggcgacacttctgcagatgtttgggctgcgccgccgcccgcagcctagcaagagtgccgtcattccggactacatgcgggatctttaccggcttcagtstggggaggaggaggaagagcagatccacagcactggtcttgagtatcctgagcgcccggccagccgggccaacaccgtgaggagcttccaccacgaagaa

SEQ ID NO: 1597 - DNA, 201 bp, Homo sapiens
gcctgggcacctcatcacacgactactggacacgagactggtccaccacaatgtgacacggtgggaaacttttgatgtgagccctgcggtccttcgctggrcccgggagaagcagccaaactatgggctagccattgaggtgactcacctccatcagactcggacccaccagggccagcatgtcaggattagccgatcgtt

SEQ ID NO: 1598 - DNA, 201 bp, Homo sapiens
agcttccaccacgaagaacatctggagaacatcccagggaccagtgaaaactctgcttttcgtttcctctttaacctcagcagcatccctgagaacgaggygatctcctctgcagagcttcggctcttccgggagcaggtggaccagggccctgattgggaaaggggcttccaccgtataaacatttatgaggttatgaag

SEQ ID NO: 1599 - DNA, 201 bp, Homo sapiens
tgggcacctcatcacacgactactggacacgagactggtccaccacaatgtgacacggtgggaaacttttgatgtgagccctgcggtccttcgctggaccygggagaagcagccaaactatgggctagccattgaggtgactcacctccatcagactcggacccaccagggccagcatgtcaggattagccgatcgttacc

SEQ ID NO: 1600 - DNA, 201 bp, Homo sapiens
caccacatacaccacacacacacgttcccatccactcacccacacactacacagactgcttccttatagctggacttttatttaaaaaaaaaaaaaaaaawggaaaaaatccctaaacattcaccttgaccttatttatgactttacgtgcaaatgttttgaccatattgatcatatattttgacaaaatatatttataac

SEQ ID NO: 1601 - DNA, 201 bp, Homo sapiens
accacatacaccacacacacacgttcccatccactcacccacacactacacagactgcttccttatagctggacttttatttaaaaaaaaaaaaaaaaaawgaaaaaatccctaaacattcaccttgaccttatttatgactttacgtgcaaatgttttgaccatattgatcatatattttgacaaaatatatttataact

SEQ ID NO: 1602 - DNA, 201 bp, Homo sapiens; identical to SEQ ID NO: 1595

SEQ ID NO: 1603 - DNA, 201 bp, Homo sapiens; identical to SEQ ID NO: 1596

SEQ ID NO: 1604 - DNA, 201 bp, Homo sapiens; identical to SEQ ID NO: 1597

SEQ ID NO: 1605 - DNA, 201 bp, Homo sapiens; identical to SEQ ID NO: 1598

SEQ ID NO: 1606 - DNA, 123 bp, Homo sapiens
gaaggaagtggcgggggaaggastgtggtggtggtttaaaaaataagggaagccgaggcgagagagacgcagacgcagaggtcgagcgcaggccgaaagctgttcaccgttttctcgactccg

SEQ ID NO: 1607 - DNA, 201 bp, Homo sapiens; identical to SEQ ID NO: 1599

SEQ ID NO: 1608 - DNA, 201 bp, Homo sapiens; identical to SEQ ID NO: 1600

SEQ ID NO: 1609 - DNA, 201 bp, Homo sapiens; identical to SEQ ID NO: 1601

SEQ ID NO: 1610 - DNA, 201 bp, Homo sapiens; identical to SEQ ID NO: 1595

SEQ ID NO: 1611 - DNA, 201 bp, Homo sapiens; identical to SEQ ID NO: 1596

SEQ ID NO: 1612 - DNA, 201 bp, Homo sapiens; identical to SEQ ID NO: 1597

SEQ ID NO: 1613 - DNA, 201 bp, Homo sapiens; identical to SEQ ID NO: 1598

SEQ ID NO: 1614 - DNA, 201 bp, Homo sapiens; identical to SEQ ID NO: 1599

SEQ ID NO: 1615 - DNA, 201 bp, Homo sapiens; identical to SEQ ID NO: 1600

SEQ ID NO: 1616 - DNA, 201 bp, Homo sapiens; identical to SEQ ID NO: 1601

SEQ ID NO: 1617 - DNA, 201 bp, Homo sapiens; identical to SEQ ID NO: 1595

SEQ ID NO: 1618 - DNA, 201 bp, Homo sapiens; identical to SEQ ID NO: 1596

SEQ ID NO: 1619 - DNA, 201 bp, Homo sapiens; identical to SEQ ID NO: 1597

SEQ ID NO: 1620 - DNA, 201 bp, Homo sapiens; identical to SEQ ID NO: 1598

SEQ ID NO: 1621 - DNA, 201 bp, Homo sapiens; identical to SEQ ID NO: 1599

SEQ ID NO: 1622 - DNA, 201 bp, Homo sapiens; identical to SEQ ID NO: 1600

SEQ ID NO: 1623 - DNA, 201 bp, Homo sapiens; identical to SEQ ID NO: 1601

SEQ ID NO: 1624 - DNA, 201 bp, Homo sapiens
tctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacac

SEQ ID NO: 1625 - DNA, 201 bp, Homo sapiens
ggcctgggtggagggagtggcaagtcaggcgtgcctcctacaagcttcctaacctcttaagcatcatggaaccagtcagccctctgtggagtcattgtgcyggacctctgaaaagatctgcaggggccaagatgttgcagccaccggaggctgcaaggatgtgggttcttccaggtgtgggcccagcccccctccttccag

SEQ ID NO: 1626 - DNA, 201 bp, Homo sapiens
gcaggcagctcggggcagggagcagcagtgcaggcctggcctgtgtccccgtgcccagcgggctcccggagcagcattccagagcctcctgcagagccagygaaggaaagctctagagggagacgactccaccgcctctctgctctgacccttctcaggcccgcctgatgtgctggaccatccccctgctgccacggcccc

SEQ ID NO: 1627 - DNA, 201 bp, Homo sapiens
ctcatgtttgtgatcctctatctggacagctctccagaatcctgtgttgcccctgttctgcctttctgggatgggagagaaggtgagggagccggcgagcmggttctaccctctctgctaagggcctagcacgctttgatgaggttcctggacgtgagaccctcacaaagaccaaccattcctctaatagccatttaacgg

SEQ ID NO: 1628 - DNA, 201 bp, Homo sapiens
tccagaatcctgtgttgcccctgttctgcctttctgggatgggagagaaggtgagggagccggcgagcaggttctaccctctctgctaagggcctagcacrctttgatgaggttcctggacgtgagaccctcacaaagaccaaccattcctctaatagccatttaacggtactgcagttcatgggaaaatgtcctcattct

SEQ ID NO: 1629 - DNA, 201 bp, Homo sapiens
gttcctggacgtgagaccctcacaaagaccaaccattcctctaatagccatttaacggtactgcagttcatgggaaaatgtcctcattcttaggagatagwtgctggattatataggtgaatgccttcaagaaatgtgtaatttaattccaaatagttccccccaaaatacacaaagcaaataaggccaaaatgttcattg

SEQ ID NO: 1630 - DNA, 1 bp, Homo sapiens
r

SEQ ID NO: 1631 - DNA, 201 bp, Homo sapiens
atgcctcaggactcacaggaagcattgtcgggcatgtgggtgacggcaacttccactgcatcctgctggtcaaccctgatgacgccgaggaactgggcagsgtcaaggcttttgcagaacagctgggcaggcgggcactggctctccacggaacgtgcacgggggagcatggcatcggaatgggcaagcggcagctgctgc

SEQ ID NO: 1632 - DNA, 201 bp, Homo sapiens
cagccaccaccctgcgcctgcaccctgcccctgaggccacagtggccgccacgtgtgcgttccccagtgtccaggctgctgtggacagcactgtacacatyctccaggctgcagtgcccgtagcccgcattgagttcctggatgaagtcatgatggatgcctgcaacaggtacagcaagctgaattgcttagtggcgccca

SEQ ID NO: 1633 - DNA, 131 bp, Homo sapiens
agcagtagctgctgccacagtagctgactgktcaccctgccacccagtgctcacaccctctggccagtgcctggctatggcccgactgctcaggtctgcaacctgggagctgttcccctggaggggctact

SEQ ID NO: 1634 - DNA, 108 bp, Homo sapiens
agcagtakctgctgccacagtagctgactggtcaccctgccacccagtgctcacaccctctggccagtgcctggctatggcccgactgctcaggtctgcaacctggga

SEQ ID NO: 1635 - DNA, 201 bp, Homo sapiens
tgaaccaggaggacttctctgtggtggtggagccaggtgtcacccgcaaagccctcaacgcccacctgcgggacagcggcctctggtttcccgtggacccrggcgcggacgcctctctctgtggcatggcggccaccggggcgtcggggaccaacgcggtccgctacggcaccatgcgggacaacgtgctcaacctggagg

SEQ ID NO: 1636 - DNA, 201 bp, Homo sapiens
atggcatcggaatgggcaagcggcagctgctgcaggaggaggtgggcgccgtgggcgtggagaccatgcggcagctcaaggccgtgctagacccccaaggyctcatgaatccaggcaaagtgctgtgaagggggtctgagcacttagcccacaagttccctgactacggagccggttctggaacttttcttcatgccacgg

SEQ ID NO: 1637 - DNA, 173 bp, Homo sapiens
cctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacc

SEQ ID NO: 1638 - DNA, 172 bp, Homo sapiens
ctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacc

SEQ ID NO: 1639 - DNA, 171 bp, Homo sapiens
tccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacc

SEQ ID NO: 1640 - DNA, 201 bp, Homo sapiens
tcagtgcctggggtcggtgtcttgggttccagcttcggcttctggccagaaatccctcatcacacagcctggtactcaccttgtgtgtccctgggacgtargaagagtgcagccggctacaacctcacggggctcttcgtgggctccgaggggacgctgggcctcatcacagccaccaccctgcgcctgcaccctgcccct

SEQ ID NO: 1641 - DNA, 201 bp, Homo sapiens
ctggaggtggtgctgcccgacgggcggctgctgcacacggcgggccgaggccggcatttccggtgagcgccctctgcggggggcccgggctctggccctgrgcactgctggcgggctgccctgcagagaccgggctgtgaaaagcacctcctggcggccccctggtttggcaggctaggcttcctcaggctctgaagccct

SEQ ID NO: 1642 - DNA, 201 bp, Homo sapiens
cgctacggcaccatgcgggacaacgtgctcaacctggaggtggtgctgcccgacgggcggctgctgcacacggcgggccgaggccggcatttccggtgagygccctctgcggggggcccgggctctggccctgggcactgctggcgggctgccctgcagagaccgggctgtgaaaagcacctcctggcggccccctggttt

SEQ ID NO: 1643 - DNA, 201 bp, Homo sapiens; identical to SEQ ID NO: 1631

SEQ ID NO: 1644 - DNA, 201 bp, Homo sapiens; identical to SEQ ID NO: 1632

SEQ ID NO: 1645 - DNA, 131 bp, Homo sapiens; identical to SEQ ID NO: 1633

SEQ ID NO: 1646 - DNA, 201 bp, Homo sapiens
ccatgcgggacaacgtgctcaacctggaggtggtgctgcccgacgggcggctgctgcacacggcgggccgaggccggcatttccggtgagcgccctctgcsgggggcccgggctctggccctgggcactgctggcgggctgccctgcagagaccgggctgtgaaaagcacctcctggcggccccctggtttggcaggctag

SEQ ID NO: 1647 - DNA, 108 bp, Homo sapiens; identical to SEQ ID NO: 1634

SEQ ID NO: 1648 - DNA, 201 bp, Homo sapiens; identical to SEQ ID NO: 1635

SEQ ID NO: 1649 - DNA, 201 bp, Homo sapiens; identical to SEQ ID NO: 1636

SEQ ID NO: 1650 - DNA, 173 bp, Homo sapiens; identical to SEQ ID NO: 1637

SEQ ID NO: 1651 - DNA, 172 bp, Homo sapiens; identical to SEQ ID NO: 1638

SEQ ID NO: 1652 - DNA, 171 bp, Homo sapiens; identical to SEQ ID NO: 1639

SEQ ID NO: 1653 - DNA, 201 bp, Homo sapiens
ctgcacacggcgggccgaggccggcatttccgcttcggcttctggccagaaatccctcatcacacagcctggtactcaccttgtgtgtccctgggacgtargaagagtgcagccggctacaacctcacggggctcttcgtgggctccgaggggacgctgggcctcatcacagccaccaccctgcgcctgcaccctgcccct

SEQ ID NO: 1654 - DNA, 201 bp, Homo sapiens; identical to SEQ ID NO: 1631

SEQ ID NO: 1655 - DNA, 201 bp, Homo sapiens; identical to SEQ ID NO: 1632

SEQ ID NO: 1656 - DNA, 131 bp, Homo sapiens; identical to SEQ ID NO: 1633

SEQ ID NO: 1657 - DNA, 108 bp, Homo sapiens; identical to SEQ ID NO: 1634

SEQ ID NO: 1658 - DNA, 201 bp, Homo sapiens; identical to SEQ ID NO: 1635

SEQ ID NO: 1659 - DNA, 201 bp, Homo sapiens; identical to SEQ ID NO: 1636

SEQ ID NO: 1660 - DNA, 173 bp, Homo sapiens; identical to SEQ ID NO: 1637

SEQ ID NO: 1661 - DNA, 172 bp, Homo sapiens; identical to SEQ ID NO: 1638

SEQ ID NO: 1662 - DNA, 171 bp, Homo sapiens; identical to SEQ ID NO: 1639

SEQ ID NO: 1663 - DNA, 201 bp, Homo sapiens
cccgacgccgatccggccgagccaagtaagggggacggcccgagacggagaagggagagagtgggagtttcccagcccgcagaactttcgaagttgagaaragaacccctggaacgtgcgctcagcactgggattttctggactcaacgatgactctgaataatgtcaccatgcgccagggcactgtgggcatgcagccac

SEQ ID NO: 1664 - DNA, 201 bp, Homo sapiens
ccagggcactgtgggcatgcagccacagcagcagcgctggagcatcccagctgatggcaggcatctgatggtccagaaagagccccaccagtacagccacsgcaaccgccattctgctacccctgaggaccactgccgccgaagctggtcctctgactccacagactcagtcatctcctctgagtcagggaacacctacta

SEQ ID NO: 1665 - DNA, 201 bp, Homo sapiens
gttgagaagagaacccctggaacgtgcgctcagcactgggattttctggactcaacgatgactctgaataatgtcaccatgcgccagggcactgtgggcaygcagccacagcagcagcgctggagcatcccagctgatggcaggcatctgatggtccagaaagagccccaccagtacagccaccgcaaccgccattctgct

SEQ ID NO: 1666 - DNA, 201 bp, Homo sapiens; identical to SEQ ID NO: 1664

SEQ ID NO: 1667 - DNA, 201 bp, Homo sapiens
actctgaataatgtcaccatgcgccagggcactgtgggcatgcagccacagcagcagcgctggagcatcccagctgatggcaggcatctgatggtccagawagagccccaccagtacagccaccgcaaccgccattctgctacccctgaggaccactgccgccgaagctggtcctctgactccacagactcagtcatctcc

SEQ ID NO: 1668 - DNA, 201 bp, Homo sapiens
taatgtcaccatgcgccagggcactgtgggcatgcagccacagcagcagcgctggagcatcccagctgatggcaggcatctgatggtccagaaagagcccyaccagtacagccaccgcaaccgccattctgctacccctgaggaccactgccgccgaagctggtcctctgactccacagactcagtcatctcctctgagtc

SEQ ID NO: 1669 - DNA, 201 bp, Homo sapiens
tttatttccaggaaaagcctgaccttgctatttgaacacccaagactctttagaggatgtgtttggtgttcacatgtgtttcttctattttggatagtagrgaagtaaagcttacaaagaatgcctagaacaagaacttttcatcattaaaaatttttcccagtgttctgatatgtgactttgaggccaatgagtcataaa

SEQ ID NO: 1670 - DNA, 201 bp, Homo sapiens
agaatcgtgactattattgctccatcaaactgtgaaaagaaatgatgtggaccttgctggaaacaaaggcttagcaaacaatttttgttcaatgcccaccragacatatagaattgggaactgatacatgtgtcccttataggctcaaaaattatatcttacaatttcttatttagggggaaattatttgaatcagattct

SEQ ID NO: 1671 - DNA, 201 bp, Homo sapiens
attcatggagccatcataaaaatatttttaaaatcagaattattgataccctgtagtgcaaaatgtcaatttttaatgtataatcagaagtctgaattttyataaaacatatagcataaaaacttccagtactttggttgacccttgtatgtcacagctctgctctatttattattattttgcaaaataaccattttaaca

SEQ ID NO: 1672 - DNA, 201 bp, Homo sapiens
atttttaaaatcagaattattgataccctgtagtgcaaaatgtcaatttttaatgtataatcagaagtctgaatttttataaaacatatagcataaaaacytccagtactttggttgacccttgtatgtcacagctctgctctatttattattattttgcaaaataaccattttaacatttgataaagcatatttatgaac

SEQ ID NO: 1673 - DNA, 201 bp, Homo sapiens
cagaattattgataccctgtagtgcaaaatgtcaatttttaatgtataatcagaagtctgaatttttataaaacatatagcataaaaacttccagtacttkggttgacccttgtatgtcacagctctgctctatttattattattttgcaaaataaccattttaacatttgataaagcatatttatgaacatatttcttaa

SEQ ID NO: 1674 - DNA, 201 bp, Homo sapiens
acatgtttgtgccagaaggcacgcagatcctgtgcacagcccaggcagcgctgggcaaaggctgcctggccagctccttcatctgtgtgtacctgtttacyggcgagctgtaccccacggagatcaggcagatggggatgggctttgcctctgtccacgcccgcctcgggggcctgacggcgcccctggttaccacacttg

SEQ ID NO: 1675 - DNA, 201 bp, Homo sapiens
ggtggggccattctcctatggagccgacccgacccgctcaaagctgccccgggaaccgcaggtttggttcgcgcacgccgggacttgccaaccgcacccgraaaatcggggccatgtccaaatgtttcgcttcgctgccggcagggagccgcgccgggctcgctcctgggatcaactgcacagtcctggctttggggagcg

SEQ ID NO: 1676 - DNA, 201 bp, Homo sapiens
cgcccctggttaccacacttggggaatacagcaccatcctgccacccgtgagctttggggccaccgcaatcctggctgggctggccgtctgcttcctgacygagacccgcaacatgcccctggtggagaccatcgcagccatggagaggagggtcaaagaaggctcttccaagaaacatgtagaagagaagagtgaagaaa

SEQ ID NO: 1677 - DNA, 201 bp, Homo sapiens
ccaccactgccggggccctgccaaccacactgaggcctccaccaacgactcgggggcctggctgagggccaccatacccctggaccagcttggggcccctragccctgccggcgcttcaccaagcctcagtgggccctgctgagccccaactcctccatcccgggcgcggccacggagggctgcaaggacggctgggtcta

SEQ ID NO: 1678 - DNA, 201 bp, Homo sapiens
ctgctgccgaggcccagtctgaagcgcccatgtcttccctgcagtgggatctggtgtgtgaggcccgcactctccgagacctggcgcagtccgtctacatkgccggggtgctggtgggggctgccgtgtttggcagcttggcagacaggctgggctgcaagggccccctggtctggtcctacctgcagctggcagcttcgg

SEQ ID NO: 1679 - DNA, 201 bp, Homo sapiens
ggtagtggtggccctgctggctgtggttgtggagtggatgcccacacggggccggactgtggcgggtattttgctggggtattccttcaccctgggccagstcatcctggctggggtagcctacctgattcgcccctggcggtgcctgcagtttgccatctctgctcctttcctgatctttttcctctattcttggtggct

SEQ ID NO: 1680 - DNA, 201 bp, Homo sapiens
cgctgccggcagggagccgcgccgggctcgctcctgggatcaactgcacagtcctggctttggggagcgggaggcggttctccaactctgtggcttactayggcctggccatggacctgcagaagtttgggctcagcctatacctggtgcaggccctgtttggaatcatcaacatcccggccatgctggtggccaccgcca

SEQ ID NO: 1681 - DNA, 201 bp, Homo sapiens
ggacctgcagaagtttgggctcagcctatacctggtgcaggccctgtttggaatcatcaacatcccggccatgctggtggccaccgccaccatgatttacrtgggccgccgtgccacggtggcctccttcctcatcctggccgggctcatggtgatcgccaacatgtttgtgccagaaggcacgcagatcctgtgcacagc

SEQ ID NO: 1682 - DNA, 201 bp, Homo sapiens
cgcagatcctgtgcacagcccaggcagcgctgggcaaaggctgcctggccagctccttcatctgtgtgtacctgtttaccggcgagctgtaccccacggasatcaggcagatggggatgggctttgcctctgtccacgcccgcctcgggggcctgacggcgcccctggttaccacacttggggaatacagcaccatcctgc

SEQ ID NO: 1683 - DNA, 201 bp, Homo sapiens
atgctctgggcagcatgggccgcttccagctcaaccacacagccctgctgctgctgccctgcggcctgctggcctgccacaacttcctgcagaacttcacsgccgctgtccccccccaccactgccggggccctgccaaccacactgaggcctccaccaacgactcgggggcctggctgagggccaccatacccctggacc

SEQ ID NO: 1684 - DNA, 201 bp, Homo sapiens
tcctcaactccgtctccctgcctcccgccagagttctggacctgggggacctgggctcccgggtagtggtggccctgctggctgtggttgtggagtggatrcccacacggggccggactgtggcgggtattttgctggggtattccttcaccctgggccagctcatcctggctggggtagcctacctgattcgcccctggc

SEQ ID NO: 1685 - DNA, 201 bp, Homo sapiens
cctgacggcgcccctggttaccacacttggggaatacagcaccatcctgccacccgtgagctttggggccaccgcaatcctggctgggctggccgtctgcktcctgaccgagacccgcaacatgcccctggtggagaccatcgcagccatggagaggagggtcaaagaaggctcttccaagaaacatgtagaagagaagag

SEQ ID NO: 1686 - DNA, 201 bp, Homo sapiens
ttggtggcttccagagtcatcccgctggctcctcctgcatggcaagtcccagttagctgtacagaatctgcagaaggtggctgcaatgaacgggaggaagsaggaaggggaaaggctgaccaaggaggtgatgagctcctacatccaaagcgagtttgcaagtgtctgcacctccaactcaatcttggacctcttccgaac

SEQ ID NO: 1687 - DNA, 201 bp, Homo sapiens
cggttctccaactctgtggcttactatggcctggccatggacctgcagaagtttgggctcagcctatacctggtgcaggccctgtttggaatcatcaacaycccggccatgctggtggccaccgccaccatgatttacgtgggccgccgtgccacggtggcctccttcctcatcctggccgggctcatggtgatcgccaac

SEQ ID NO: 1688 - DNA, 201 bp, Homo sapiens
ctgaagcgcccatgtcttccctgcagtgggatctggtgtgtgaggcccgcactctccgagacctggcgcagtccgtctacatggccggggtgctggtgggsgctgccgtgtttggcagcttggcagacaggctgggctgcaagggccccctggtctggtcctacctgcagctggcagcttcgggggccgccacagcgtatt

SEQ ID NO: 1689 - DNA, 201 bp, Homo sapiens
ctgctgccctgcggcctgctggcctgccacaacttcctgcagaacttcacggccgctgtccccccccaccactgccggggccctgccaaccacactgaggmctccaccaacgactcgggggcctggctgagggccaccatacccctggaccagcttggggcccctgagccctgccggcgcttcaccaagcctcagtgggcc

SEQ ID NO: 1690 - DNA, 201 bp, Homo sapiens
tgggtgtgtgggggggctgctgccgaggcccagtctgaagcgcccatgtcttccctgcagtgggatctggtgtgtgaggcccgcactctccgagacctggygcagtccgtctacatggccggggtgctggtgggggctgccgtgtttggcagcttggcagacaggctgggctgcaagggccccctggtctggtcctacctg

SEQ ID NO: 1691 - DNA, 201 bp, Homo sapiens
cggacgactacggggaccgcgagtcaggctgcagcttcgtgctcgcccttatgcagaagcaccgtcgccgcgagcgccgcttcggccgcgacatggagacwattggcttcgcggtctacgagctggtgggccagccggccgtacacttgaagcgtgacttcttcctggccaatgcgtctcgggcgcgctcagagcagttca

SEQ ID NO: 1692 - DNA, 201 bp, Homo sapiens
agcagcgggccagggagctgggcctgggccgccatgagaatgccatcaagtacctgggccaggattatgagcagctgcgggtgcgatgcctgcagagtggraccctcttccgtgatgaggccttccccccggtaccccagagcctgggttacaaggacctgggtcccaattcctccaagacctatggcatcaagtggaagc

SEQ ID NO: 1693 - DNA, 201 bp, Homo sapiens
ttacaaggacctgggtcccaattcctccaagacctatggcatcaagtggaagcgtcccacggaactgctgtcaaacccccagttcattgtggatggagctrcccgcacagacatctgccagggagcactgggggactgctggctcttggcggccatcgcctccctcactctcaacgacaccctcctgcaccgagtggttcc

SEQ ID NO: 1694 - DNA, 201 bp, Homo sapiens
cggctggatgagacggatgacccggacgactacggggaccgcgagtcaggctgcagcttcgtgctcgcccttatgcagaagcaccgtcgccgcgagcgccscttcggccgcgacatggagactattggcttcgcggtctacgagctggtgggccagccggccgtacacttgaagcgtgacttcttcctggccaatgcgtct

SEQ ID NO: 1695 - DNA, 201 bp, Homo sapiens
ggccgcgacatggagactattggcttcgcggtctacgagctggtgggccagccggccgtacacttgaagcgtgacttcttcctggccaatgcgtctcgggygcgctcagagcagttcatcaacctgcgagaggtcagcacccgcttccgcctgccacccggggagtatgtggtggtgccctccaccttcgagcccaacaag

SEQ ID NO: 1696 - DNA, 201 bp, Homo sapiens
ccacggaactgctgtcaaacccccagttcattgtggatggagctacccgcacagacatctgccagggagcactgggggactgctggctcttggcggccatygcctccctcactctcaacgacaccctcctgcaccgagtggttccgcacggccagagcttccagaatggctatgccggcatcttccatttccagctgtggc

SEQ ID NO: 1697 - DNA, 201 bp, Homo sapiens
cccattgccaagccaggaaggcagctttcgcttgttcctgcctcgggacagccccgggtttccccagcatcctgatgtgtcccctctccccacttcagagsccacccactcagcaccaccggcctggccttgcctgcagactataaactataaccactagctcgacacagtctgcagtccaggcgtgtggagccgcctccc

SEQ ID NO: 1698 - DNA, 201 bp, Homo sapiens
cggacgactacggggaccgcgagtcaggctgcagcttcgtgctcgcccttatgcagaagcaccgtcgccgcgagcgccgcttcggccgcgacatggagacwattggcttcgcggtctacgaggtcaggaggctggtgggccagccggccgtacacttgaagcgtgacttcttcctggccaatgcgtctcgggcgcgctcag

SEQ ID NO: 1699 - DNA, 201 bp, Homo sapiens; identical to SEQ ID NO: 1692

SEQ ID NO: 1700 - DNA, 201 bp, Homo sapiens; identical to SEQ ID NO: 1693

SEQ ID NO: 1701 - DNA, 201 bp, Homo sapiens
cggctggatgagacggatgacccggacgactacggggaccgcgagtcaggctgcagcttcgtgctcgcccttatgcagaagcaccgtcgccgcgagcgccscttcggccgcgacatggagactattggcttcgcggtctacgaggtcaggaggctggtgggccagccggccgtacacttgaagcgtgacttcttcctggcc

SEQ ID NO: 1702 - DNA, 201 bp, Homo sapiens
atggagactattggcttcgcggtctacgaggtcaggaggctggtgggccagccggccgtacacttgaagcgtgacttcttcctggccaatgcgtctcgggygcgctcagagcagttcatcaacctgcgagaggtcagcacccgcttccgcctgccacccggggagtatgtggtggtgccctccaccttcgagcccaacaag

SEQ ID NO: 1703 - DNA, 201 bp, Homo sapiens; identical to SEQ ID NO: 1696

SEQ ID NO: 1704 - DNA, 201 bp, Homo sapiens; identical to SEQ ID NO: 1697

SEQ ID NO: 1705 - DNA, 201 bp, Homo sapiens
cggacgactacggggaccgcgagtcaggctgcagcttcgtgctcgcccttatgcagaagcaccgtcgccgcgagcgccgcttcggccgcgacatggagacwattggcttcgcggtctacgagtcccaccagctggtgggccagccggccgtacacttgaagcgtgacttcttcctggccaatgcgtctcgggcgcgctcag

SEQ ID NO: 1706 - DNA, 201 bp, Homo sapiens; identical to SEQ ID NO: 1692

SEQ ID NO: 1707 - DNA, 201 bp, Homo sapiens; identical to SEQ ID NO: 1693

SEQ ID NO: 1708 - DNA, 201 bp, Homo sapiens
cggctggatgagacggatgacccggacgactacggggaccgcgagtcaggctgcagcttcgtgctcgcccttatgcagaagcaccgtcgccgcgagcgccscttcggccgcgacatggagactattggcttcgcggtctacgagtcccaccagctggtgggccagccggccgtacacttgaagcgtgacttcttcctggcc

SEQ ID NO: 1709 - DNA, 201 bp, Homo sapiens
atggagactattggcttcgcggtctacgagtcccaccagctggtgggccagccggccgtacacttgaagcgtgacttcttcctggccaatgcgtctcgggygcgctcagagcagttcatcaacctgcgagaggtcagcacccgcttccgcctgccacccggggagtatgtggtggtgccctccaccttcgagcccaacaag

SEQ ID NO: 1710 - DNA, 201 bp, Homo sapiens; identical to SEQ ID NO: 1696

SEQ ID NO: 1711 - DNA, 201 bp, Homo sapiens; identical to SEQ ID NO: 1697

SEQ ID NO: 1712 - DNA, 167 bp, Homo sapiens
tcatcatcacccgctactcggagcccgacctggcggtcgactttgacaatttcgtttgctgcctggtgcggctagagaccatgttccgtgagtgtccccarctgcctcccaccctccagctccgtcccaaacgcgtcccccaggagctggggggaatgacagatggg

SEQ ID NO: 1713 - DNA, 153 bp, Homo sapiens
cgggaaaggagaggtggccggcacgcctgggaactgggaaatccctttcctgsattcactgggagcaccgggaggtggctgagaaccctacttctgtgaggggagcagtgaggcagggaaaccctaggtttggggatggataagcaggggcag

SEQ ID NO: 1714 - DNA, 169 bp, Homo sapiens
cgggaaaggagaggtggccggcacgcctgggaactgggaaatccctttcctggattcactgggagcacygggaggtggctgagaaccctacttctgtgaggggagcagtgaggcagggaaaccctaggtttggggatggataagcaggggcaggagagcagagcttgca

SEQ ID NO: 1715 - DNA, 201 bp, Homo sapiens; identical to SEQ ID NO: 1705

SEQ ID NO: 1716 - DNA, 201 bp, Homo sapiens
gagaggtggccggcacgcctgggaactgggaaatccctttcctggattcactgggagcaccgggaggtggctgagaaccctacttctgtgaggggagcagygaggcagggaaaccctaggtttggggatggataagcaggggcaggagagcagagcttgcaggcaggagcccaggttctagtcttgggaaggcctgggttc

SEQ ID NO: 1717 - DNA, 201 bp, Homo sapiens; identical to SEQ ID NO: 1692

SEQ ID NO: 1718 - DNA, 201 bp, Homo sapiens; identical to SEQ ID NO: 1693

SEQ ID NO: 1719 - DNA, 201 bp, Homo sapiens; identical to SEQ ID NO: 1708

SEQ ID NO: 1720 - DNA, 201 bp, Homo sapiens; identical to SEQ ID NO: 1709

SEQ ID NO: 1721 - DNA, 201 bp, Homo sapiens; identical to SEQ ID NO: 1696

SEQ ID NO: 1722 - DNA, 201 bp, Homo sapiens; identical to SEQ ID NO: 1697

SEQ ID NO: 1723 - DNA, 201 bp, Homo sapiens; identical to SEQ ID NO: 1691

SEQ ID NO: 1724 - DNA, 201 bp, Homo sapiens; identical to SEQ ID NO: 1692

SEQ ID NO: 1725 - DNA, 201 bp, Homo sapiens; identical to SEQ ID NO: 1693

SEQ ID NO: 1726 - DNA, 201 bp, Homo sapiens; identical to SEQ ID NO: 1694

SEQ ID NO: 1727 - DNA, 201 bp, Homo sapiens; identical to SEQ ID NO: 1695

SEQ ID NO: 1728 - DNA, 201 bp, Homo sapiens; identical to SEQ ID NO: 1696

SEQ ID NO: 1729 - DNA, 201 bp, Homo sapiens
cccattgccaagccaggaaggcagctttcgcttgttcctgcctcgggacagccccgggtttccccagcatcctgatgtgtcccctctccccacttcagagsccacccactcagcaccaccggcctggccttgcctgcagactataaactataaccactagctcgacacagtctgcagtccaggcgtgtggagctgcccagc

SEQ ID NO: 1730 - DNA, 201 bp, Homo sapiens
aggcggactgcgcagtgctgatcgtggcggcgggcgtgggcgagttcgaggcgggcatctccaagaatgggcagacgcgggagcatgccctgctggcctayacgctgggtgtgaagcagctcatcgtgggcgtgaacaaaatggactccacagagccggcctacagcgagaagcgctacgacgagatcgtcaaggaagtca

SEQ ID NO: 1731 - DNA, 201 bp, Homo sapiens
agcgctacgacgagatcgtcaaggaagtcagcgcctacatcaagaagatcggctacaacccggccaccgtgccctttgtgcccatctccggctggcacggygacaacatgctggagccctcccccaacatgccgtggttcaagggctggaaggtggagcgtaaggagggcaacgcaagcggcgtgtccctgctggaggccc

SEQ ID NO: 1732 - DNA, 201 bp, Homo sapiens
tctccaagaatgggcagacgcgggagcatgccctgctggcctacacgctgggtgtgaagcagctcatcgtgggcgtgaacaaaatggactccacagagccrgcctacagcgagaagcgctacgacgagatcgtcaaggaagtcagcgcctacatcaagaagatcggctacaacccggccaccgtgccctttgtgcccatct

SEQ ID NO: 1733 - DNA, 201 bp, Homo sapiens
cggctgagatggggaagggatccttcaagtatgcctgggtgctggacaagctgaaggcggagcgtgagcgcggcatcaccatcgacatctccctctggaarttcgagaccaccaagtactacatcaccatcatcgatgcccccggccaccgcgacttcatcaagaacatgatcacgggtacatcccaggcggactgcgcag

SEQ ID NO: 1734 - DNA, 201 bp, Homo sapiens
cccccggccaccgcgacttcatcaagaacatgatcacgggtacatcccaggcggactgcgcagtgctgatcgtggcggcgggcgtgggcgagttcgaggcrggcatctccaagaatgggcagacgcgggagcatgccctgctggcctacacgctgggtgtgaagcagctcatcgtgggcgtgaacaaaatggactccacag

SEQ ID NO: 1735 - DNA, 201 bp, Homo sapiens
aaaggaccattgagaagttcgagaaggaggcggctgagatggggaagggatccttcaagtatgcctgggtgctggacaagctgaaggcggagcgtgagcgyggcatcaccatcgacatctccctctggaagttcgagaccaccaagtactacatcaccatcatcgatgcccccggccaccgcgacttcatcaagaacatga

SEQ ID NO: 1736 - DNA, 201 bp, Homo sapiens
gcttttcgcggctcaagcgtgttcctgccctgagccggctctcgccccgtctcccgggcccgccgcgctctccccgcgccgtctccgtcccggtccctccytcccgccgcctccctgccctgccccccgccccgcccccgccgcggcgcgtttctcccccgcctcccgcgtccgtctttgcagcccgcgcctcccgcatgc

SEQ ID NO: 1737 - DNA, 201 bp, Homo sapiens
ccatgtgtgtggagagcttctcccagtacccgcctctcggccgcttcgccgtgcgcgacatgaggcagacggtggccgtaggcgtcatcaagaacgtggaraagaagagcggcggcgccggcaaggtcaccaagtcggcgcagaaggcgcagaaggcgggcaagtgaagcgcgggcgcccgcggcgcgaccctccccggcg

SEQ ID NO: 1738 - DNA, 201 bp, Homo sapiens
agaagagcggcggcgccggcaaggtcaccaagtcggcgcagaaggcgcagaaggcgggcaagtgaagcgcgggcgcccgcggcgcgaccctccccggcggygccgcgctccgaaccccgggcccgggcccccgccccgcccccgccccgcgcgccggtccggcgccccgcacccccgccaggcgcatgtctgcacctccgc

SEQ ID NO: 1739 - DNA, 201 bp, Homo sapiens
ggcaagtgaagcgcgggcgcccgcggcgcgaccctccccggcggtgccgcgctccgaaccccgggcccgggcccccgccccgcccccgccccgcgcgccgstccggcgccccgcacccccgccaggcgcatgtctgcacctccgcttgccagaggccctcggtcagcgactggatgctcgccatcaaggtccagtggaagt

SEQ ID NO: 1740 - DNA, 201 bp, Homo sapiens; identical to SEQ ID NO: 1730

SEQ ID NO: 1741 - DNA, 201 bp, Homo sapiens; identical to SEQ ID NO: 1731

SEQ ID NO: 1742 - DNA, 201 bp, Homo sapiens; identical to SEQ ID NO: 1732

SEQ ID NO: 1743 - DNA, 201 bp, Homo sapiens; identical to SEQ ID NO: 1733

SEQ ID NO: 1744 - DNA, 201 bp, Homo sapiens; identical to SEQ ID NO: 1734

SEQ ID NO: 1745 - DNA, 201 bp, Homo sapiens; identical to SEQ ID NO: 1735

SEQ ID NO: 1746 - DNA, 201 bp, Homo sapiens; identical to SEQ ID NO: 1737

SEQ ID NO: 1747 - DNA, 201 bp, Homo sapiens; identical to SEQ ID NO: 1738

SEQ ID NO: 1748 - DNA, 201 bp, Homo sapiens; identical to SEQ ID NO: 1739

SEQ ID NO: 1749 - DNA, 201 bp, Homo sapiens; identical to SEQ ID NO: 1730

SEQ ID NO: 1750 - DNA, 201 bp, Homo sapiens; identical to SEQ ID NO: 1731

SEQ ID NO: 1751 - DNA, 201 bp, Homo sapiens; identical to SEQ ID NO: 1732

SEQ ID NO: 1752 - DNA, 201 bp, Homo sapiens; identical to SEQ ID NO: 1733

SEQ ID NO: 1753 - DNA, 201 bp, Homo sapiens; identical to SEQ ID NO: 1734

SEQ ID NO: 1754 - DNA, 201 bp, Homo sapiens; identical to SEQ ID NO: 1735

SEQ ID NO: 1755 - DNA, 201 bp, Homo sapiens; identical to SEQ ID NO: 1737

SEQ ID NO: 1756 - DNA, 201 bp, Homo sapiens; identical to SEQ ID NO: 1738

SEQ ID NO: 1757 - DNA, 201 bp, Homo sapiens; identical to SEQ ID NO: 1739

SEQ ID NO: 1758 - DNA, 201 bp, Homo sapiens
cggcacttctacgtggccaagggcaaccccatccacgccaggggcaaggttccgccccacccccggcactacccgctcatgttctgccacgtggcgggcarcccagaccgggacatgtccatggcgtcctggctgaatctggctgagattgcgcaggtcgtcgagaaggtgcaggaggcctacaacacctggcccagctgc

SEQ ID NO: 1759 - DNA, 201 bp, Homo sapiens
gcggcgggagctggtgcaggtgcagcggagccactgtggccatttcctggaggtggcccgggagctgggcagtggggacaccctgcaggtgcagctcggcrccagcctgcagcacggcttcctggtaccgagccctcagctctggacggtggcaccgggcttcagcctctgcctggagcacgtggagcggcccggagactg

SEQ ID NO: 1760 - DNA, 201 bp, Homo sapiens
ggccctcaccccgctggcctacgcctcgcacggcacccgcctcgtgctggcgggcgaccacatgcaggtcacaccccggctgttcagtgtggccagggccygggcggccgagcacacgctgctgcaccgcctcttcctgtgctaccagcaggagactcacgaggtggcgcggcagagccgcctggtcttccacgagaacta

SEQ ID NO: 1761 - DNA, 201 bp, Homo sapiens
gccactcctctccgtgtgatgtacacggaccggccgctgagccagacggacccagtcacgctgcagtactgttgcctgaccgacgaccgccaggctttccrcccgcccacacgggcagagctggcgcggcaccgcgtggtggtcaccaccacctcccaggcccgtgagctcagggtgccggtcggcttcttctcccacatt

SEQ ID NO: 1762 - DNA, 201 bp, Homo sapiens
ctgcagggcgccttccgcctggaggccgccttcctcgaggagaactgtgccgacatcaacttcagctgctgctacctctgcatccggctcgaggggctgcyggctcccacggccagcccacgccctgggcccagcagcctcggccctggcctgaatgttgaccccggcacgtatacctgggtggcccacgggcagacgcag

SEQ ID NO: 1763 - DNA, 201 bp, Homo sapiens
gtggacttggtcaccacggacgacatgcacccattcctggctcctgcaggccgcgacctccgcaaggccctggagcgctcggcgttcggccgctgcgcccrgggccaccagcagcagggcggccactactcgctgcaggtggactggtacacgtgggccacctcgcccatccgcaggtacctggacgtggtgttgcagcgg

SEQ ID NO: 1764 - DNA, 201 bp, Homo sapiens
caacagtttgtggtggtgaggccgcggccccgggccggccagcctcctgcctactgcaggtttgtggggcgtgggcagccgtgctggcgtggggagtcccyctgccagtttgcacacagcgccgtggagatggctgtgtgggaggccgagcagctgggtggcctccagcggggggacctgctcacaccccctgcccctgat

SEQ ID NO: 1765 - DNA, 201 bp, Homo sapiens
ggggcaggccgggcggccgacgccatccttacggagtttggcggccgcttcgagctgctttgctccctctgcttcaggcgctgtcccccatgcatctgtcrcgtggacccccaggggcagtgccctgagcacggagcctgcccctccctcctggcccacgtgagcgccgagggccgccgcaagcaacagtttgtggtggtg

SEQ ID NO: 1766 - DNA, 201 bp, Homo sapiens
caggcatggccacggaacctgaaaccctcatccccctggtgcagttcccacaggccgagaaggtggttcttctcggagaccacaagcagctgcggcctgtrgtcaagaatgagcggctgcaaaacctgggtctggaccggtctctgttcgagcggtaccacgaggacgcacatatgctggacactcagtaccgcatgcatg

SEQ ID NO: 1767 - DNA, 201 bp, Homo sapiens
tgcaggtggactggtacacgtgggccacctcgcccatccgcaggtacctggacgtggtgttgcagcggcagatcctgctggcgctgggccatgggggctcygcctactctgccagggacatcgatgggctctgccaggccttcagcctccagcacgcacttgcccagagctatcagcggcgggcgcgcagcctgcacctgg

SEQ ID NO: 1768 - DNA, 201 bp, Homo sapiens
tccagtctgaccgccagctgtcctacgaggaggcggaggaggtgatcaggcagcacccgggtgccggccgtgagctgccggcccgcctggactccgtggaygcctgcgtcgtggccgcgtgctacttctctcggctgctgcgccggcaccgcctgcggtccgactgcttctatgagcagccggacgaggacggcaccctgg

SEQ ID NO: 1769 - DNA, 201 bp, Homo sapiens
tcgagaaggtgcaggaggcctacaacacctggcccagctgctggggcggccgcgagcagaggtgcatctgtgtcgtttcccacggtgcccagttccgggtygtggtgctcagcactgtgcacacctgccagagcctgctcagccctggggcactggcccctgagttcttcaccgacgcccgcgtgctcaacaccgtcctga

SEQ ID NO: 1770 - DNA, 201 bp, Homo sapiens
tccacgagaactaccgctgcacggacgccattgtcagcttcatctcgcggcacttctacgtggccaagggcaaccccatccacgccaggggcaaggttccsccccacccccggcactacccgctcatgttctgccacgtggcgggcaacccagaccgggacatgtccatggcgtcctggctgaatctggctgagattgcgc

SEQ ID NO: 1771 - DNA, 201 bp, Homo sapiens
tgcttccggctgctcttccccagcaaccgggagacgctgcctgacccctgccccgtcccctacggctccctgcagctggccgagcacccccacgccctggyaggccggccgggcctgcggctcctgtggcggcgccgtgtctactcagcgcagggatccagcccgcccctgccactgcctggcactgtgccggacccacac

SEQ ID NO: 1772 - DNA, 201 bp, Homo sapiens
tggctcccggcctcccgccaggccggctctacgcacggggtgagcgcttccgtgtgcccagctccactgccgacttccaggtgggagtgcgtgtgcaggcygcctcgttcggcacctttgagcaatgggtggtcttcgactttggccgccggccggtgctgctacaaaagctggggctgcagctgggccaggggcgtcgcc

SEQ ID NO: 1773 - DNA, 201 bp, Homo sapiens
cttctctctggtggctcccggcctcccgccaggccggctctacgcacggggtgagcgcttccgtgtgcccagctccactgccgacttccaggtgggagtgygtgtgcaggccgcctcgttcggcacctttgagcaatgggtggtcttcgactttggccgccggccggtgctgctacaaaagctggggctgcagctgggcca

SEQ ID NO: 1774 - DNA, 201 bp, Homo sapiens
aggcttctactacccgctgggcatcgtccgggaggtgctgcctgaggccagcacctgggagcagggcctccgcatcctcggcctggagtacagcttgaggktgcccccgtcggaccaggccaccatcaccaaggtgctgcagaaataccacacggagcttggccgggttgccggccgccgagaggactgccgcgccttctt

SEQ ID NO: 1775 - DNA, 201 bp, Homo sapiens
tggaggccgccttcctcgaggagaactgtgccgacatcaacttcagctgctgctacctctgcatccggctcgaggggctgccggctcccacggccagcccmcgccctgggcccagcagcctcggccctggcctgaatgttgaccccggcacgtatacctgggtggcccacgggcagacgcaggactgggaccaggagcgcc

SEQ ID NO: 1776 - DNA, 201 bp, Homo sapiens
gcaagctgaagacgtggcagggcctgaggaggccgcccagtgtcctgggccacgctggcaaggagagctgccctgtcatctttggccacgtgcagggccaygagcggagcctgctggtgtccacggacgaagggaatgagaactccaaggccaacctggaggaggtggctgaggtggcccttcggcgagagggcatcgccg

SEQ ID NO: 1777 - DNA, 201 bp, Homo sapiens
gcaccgtccgcacctgtgccaagagcgacctggaccagcggcccaccaagagctggctcaagaagtttctgggcttcgttgtggaccccaaccaagtgaaygtggctgtcacgcgggcccaggaggggctctgcctgatcggagaccacctccttctgcgctgctgccccctctggcgtagcctcctggacttctgcgagg

SEQ ID NO: 1778 - DNA, 201 bp, Homo sapiens
ccggccagcctcctgcctactgcaggtttgtggggcgtgggcagccgtgctggcgtggggagtcccgctgccagtttgcacacagcgccgtggagatggcygtgtgggaggccgagcagctgggtggcctccagcggggggacctgctcacaccccctgcccctgatggcgacgggcgcacggccccccttggccagcccc

SEQ ID NO: 1779 - DNA, 201 bp, Homo sapiens
gccggctcccacggccagcccacgccctgggcccagcagcctcggccctggcctgaatgttgaccccggcacgtatacctgggtggcccacgggcagacgsaggactgggaccaggagcgccgggcagaccggcaggaggctcccagacgggtgcacctcttcgtccaccacatgggcatggagaaggttccggaagaggt

SEQ ID NO: 1780 - DNA, 201 bp, Homo sapiens
ggccgcggccccgggccggccagcctcctgcctactgcaggtttgtggggcgtgggcagccgtgctggcgtggggagtcccgctgccagtttgcacacagygccgtggagatggctgtgtgggaggccgagcagctgggtggcctccagcggggggacctgctcacaccccctgcccctgatggcgacgggcgcacggccc

SEQ ID NO: 1781 - DNA, 201 bp, Homo sapiens
gaagggcgaggcgtcccagcggcgggagctggtgcaggtgcagcggagccactgtggccatttcctggaggtggcccgggagctgggcagtggggacaccytgcaggtgcagctcggcaccagcctgcagcacggcttcctggtaccgagccctcagctctggacggtggcaccgggcttcagcctctgcctggagcacgt

SEQ ID NO: 1782 - DNA, 201 bp, Homo sapiens
tgacccgcgcccagtcccagctggtggtagtgggggacgccgtggccctctgctccttcggggcctgcggcaagctctgggagagcttcatccgtgagtgygtggagcggcacagtgtctgccccgagggcctgtccatggagcaggtcgagcagggtgtggcgcagagacggcgctggcctccccgaggcacacaggctg

SEQ ID NO: 1783 - DNA, 201 bp, Homo sapiens
tggcgcagagacggcgctggcctccccgaggcacacaggctggggcagcggggaactgggaggctgccccagagccagtaggggacctggccgaggagcargcggctgtggtgacggccatggtgaaggcagagccgggagatgaggctctgagcccagcatcccgtgacatcacggcaaccacagcgcagacggaggctg

SEQ ID NO: 1784 - DNA, 201 bp, Homo sapiens
gtggcctccagcggggggacctgctcacaccccctgcccctgatggcgacgggcgcacggccccccttggccagccccctggggcccagctgtactgcccsgcctgcttggtcacctgccactctcaggaggccttcgagaaccactgcgcatcctcggagcacgcacagatggtggccttcgaccaggccctgccctggg

SEQ ID NO: 1785 - DNA, 201 bp, Homo sapiens
ggtctggaccttcgagcgtcagcacaacctccagcgcctatggctgaaggcggaggtgcagggcagcggggcccagggaggggcaggccgggcggccgacrccatccttacggagtttggcggccgcttcgagctgctttgctccctctgcttcaggcgctgtcccccatgcatctgtcgcgtggacccccaggggcagtg

SEQ ID NO: 1786 - DNA, 201 bp, Homo sapiens
gggacggggagctcaacgctgacgacgccatcctacgggagcttctggacgagagccagaaggtgatggtgaccgtcggggaggacgggctgctggacacygtcgccaggcccgagtccctgcagcaggcccggctgtacgagaacctgcccccggctgcgctacggaagctgctgcgcgcggagcccgagcggtaccgcc

SEQ ID NO: 1787 - DNA, 201 bp, Homo sapiens
cggaagctgctgcgcgcggagcccgagcggtaccgccactgctctttcgtgccagagaccttcgagcgggcgtcagccatcccgctggacgatgcctcctygggccccatccaggtcaggggccgcctggactgtgggatggccttcgccggggatgaggtgctggtgcagctcctttcgggagacaaggcgcccgagggg

SEQ ID NO: 1788 - DNA, 201 bp, Homo sapiens
aggcccgtgagctcagggtgccggtcggcttcttctcccacattctcatcgatgaggcggcccagatgctggagtgcgaggccctcaccccgctggcctaygcctcgcacggcacccgcctcgtgctggcgggcgaccacatgcaggtcacaccccggctgttcagtgtggccagggcccgggcggccgagcacacgctgc

SEQ ID NO: 1789 - DNA, 201 bp, Homo sapiens
tccactctgaggagcccctgctacacgtggccctgctgaagcaggagccaggagccgacttctctctggtggctcccggcctcccgccaggccggctctaygcacggggtgagcgcttccgtgtgcccagctccactgccgacttccaggtgggagtgcgtgtgcaggccgcctcgttcggcacctttgagcaatgggtgg

SEQ ID NO: 1790 - DNA, 201 bp, Homo sapiens
aaccattctgcgccctggagtcggccaccggcgcggttgccgagaatgactccgtcacacttcagcacctgagtgtctcctgggaggcgtcacggacgccrcaggggcagctgcagggcgccttccgcctggaggccgccttcctcgaggagaactgtgccgacatcaacttcagctgctgctacctctgcatccggctcg

SEQ ID NO: 1791 - DNA, 201 bp, Homo sapiens
tgaccgccagctgtcctacgaggaggcggaggaggtgatcaggcagcacccgggtgccggccgtgagctgccggcccgcctggactccgtggacgcctgcrtcgtggccgcgtgctacttctctcggctgctgcgccggcaccgcctgcggtccgactgcttctatgagcagccggacgaggacggcaccctgggcttccg

SEQ ID NO: 1792 - DNA, 201 bp, Homo sapiens
gggacggggtgctggacgtggaggcgcgaaggcagggcgctgcgttctatgcccccggcagggagccagtgcccatgctgccggccagcctctgccaggaygtcctcagcctcctgcctggccgggaccgcctggccatctccctgttcctcaccatggagaaggccagtggccagctgaagagcctgcgctttgcaccct

SEQ ID NO: 1793 - DNA, 201 bp, Homo sapiens
gcagcagtgaggtccttgtgctggcagagacccttgatggagtgcgtgtcacctgcaaccagcccctgatgtaccaggcccaggagaggaagacccagtayagctggacgtttgccgtccactctgaggagcccctgctacacgtggccctgctgaagcaggagccaggagccgacttctctctggtggctcccggcctcc

SEQ ID NO: 1794 - DNA, 201 bp, Homo sapiens
acgagcggagcctgctggtgtccacggacgaagggaatgagaactccaaggccaacctggaggaggtggctgaggtggcccttcggcgagagggcatcgcyggggtggccgtgtcctccatcaccaagagccaggggagcgagtggcgctatgtgctggtgagcaccgtccgcacctgtgccaagagcgacctggaccagc

SEQ ID NO: 1795 - DNA, 201 bp, Homo sapiens
cagggcgcctgcaacctcgatgatgccctcagtgtccgagacctgggtcccaggtgcgaggtggctgtgcacatcactgatgtggccagcttcgtgcccarggacggggtgctggacgtggaggcgcgaaggcagggcgctgcgttctatgcccccggcagggagccagtgcccatgctgccggccagcctctgccaggac

SEQ ID NO: 1796 - DNA, 201 bp, Homo sapiens
cgccaggccggctctacgcacggggtgagcgcttccgtgtgcccagctccactgccgacttccaggtgggagtgcgtgtgcaggccgcctcgttcggcacytttgagcaatgggtggtcttcgactttggccgccggccggtgctgctacaaaagctggggctgcagctgggccaggggcgtcgcccaggaccctgcagga

SEQ ID NO: 1797 - DNA, 201 bp, Homo sapiens
ccgccttcctcgaggagaactgtgccgacatcaacttcagctgctgctacctctgcatccggctcgaggggctgccggctcccacggccagcccacgcccygggcccagcagcctcggccctggcctgaatgttgaccccggcacgtatacctgggtggcccacgggcagacgcaggactgggaccaggagcgccgggcag

SEQ ID NO: 1798 - DNA, 201 bp, Homo sapiens
gcgtggtggtcaccaccacctcccaggcccgtgagctcagggtgccggtcggcttcttctcccacattctcatcgatgaggcggcccagatgctggagtgygaggccctcaccccgctggcctacgcctcgcacggcacccgcctcgtgctggcgggcgaccacatgcaggtcacaccccggctgttcagtgtggccaggg

SEQ ID NO: 1799 - DNA, 201 bp, Homo sapiens
caatgggtggtcttcgactttggccgccggccggtgctgctacaaaagctggggctgcagctgggccaggggcgtcgcccaggaccctgcaggaatctggygctcggccaccctgaggagatggagcgctggcacactggcaaccgccacgtggtgcctggcgtggagcggacggccgagcagacggccctgatggccaag

SEQ ID NO: 1800 - DNA, 201 bp, Homo sapiens
tgcacacagcgccgtggagatggctgtgtgggaggccgagcagctgggtggcctccagcggggggacctgctcacaccccctgcccctgatggcgacgggygcacggccccccttggccagccccctggggcccagctgtactgcccggcctgcttggtcacctgccactctcaggaggccttcgagaaccactgcgcatc

SEQ ID NO: 1801 - DNA, 201 bp, Homo sapiens
gagtgcgtgtcacctgcaaccagcccctgatgtaccaggcccaggagaggaagacccagtacagctggacgtttgccgtccactctgaggagcccctgctrcacgtggccctgctgaagcaggagccaggagccgacttctctctggtggctcccggcctcccgccaggccggctctacgcacggggtgagcgcttccgtg

SEQ ID NO: 1802 - DNA, 201 bp, Homo sapiens
ggcccagggaggggcaggccgggcggccgacgccatccttacggagtttggcggccgcttcgagctgctttgctccctctgcttcaggcgctgtcccccaygcatctgtcgcgtggacccccaggggcagtgccctgagcacggagcctgcccctccctcctggcccacgtgagcgccgagggccgccgcaagcaacagtt

SEQ ID NO: 1803 - DNA, 201 bp, Homo sapiens
ggggaggacgggctgctggacaccgtcgccaggcccgagtccctgcagcaggcccggctgtacgagaacctgcccccggctgcgctacggaagctgctgcrcgcggagcccgagcggtaccgccactgctctttcgtgccagagaccttcgagcgggcgtcagccatcccgctggacgatgcctcctcgggccccatccag

SEQ ID NO: 1804 - DNA, 201 bp, Homo sapiens
gcatcctcggcctggagtacagcttgagggtgcccccgtcggaccaggccaccatcaccaaggtgctgcagaaataccacacggagcttggccgggttgcsggccgccgagaggactgccgcgccttcttgaccttcactgtggacccccagggcgcctgcaacctcgatgatgccctcagtgtccgagacctgggtccca

SEQ ID NO: 1805 - DNA, 201 bp, Homo sapiens
ccacacgggcagagctggcgcggcaccgcgtggtggtcaccaccacctcccaggcccgtgagctcagggtgccggtcggcttcttctcccacattctcatygatgaggcggcccagatgctggagtgcgaggccctcaccccgctggcctacgcctcgcacggcacccgcctcgtgctggcgggcgaccacatgcaggtca

SEQ ID NO: 1806 - DNA, 201 bp, Homo sapiens
gtgccttcccctctgtggcgttctacaagagcaagctgaagacgtggcagggcctgaggaggccgcccagtgtcctgggccacgctggcaaggagagctgycctgtcatctttggccacgtgcagggccacgagcggagcctgctggtgtccacggacgaagggaatgagaactccaaggccaacctggaggaggtggctg

SEQ ID NO: 1807 - DNA, 201 bp, Homo sapiens
agtcggtggatgtcctggcaggactgctcctgagaaggatggagctgaagcccctccgtgtgtacagtgagcaggctgaggccagcgagttcccagtgccrcgtgtgggcagcaggaagctgctcaggaagagcccccgggaggggaggccgaaccagagcctcaggagcatcaccctgcaccaccggatccggcaggccc

SEQ ID NO: 1808 - DNA, 201 bp, Homo sapiens
cctgtcccgcagcccctctgcagagggaagacgatcgtgggcctccacatcgtattctggtttcataaatcaaaccaggagcaggtgcagcccggaggccscccccgtggggagaagcggctggggggtccctgcatcttgtactgcggcccctccaacaagtcggtggatgtcctggcaggactgctcctgagaaggatg

SEQ ID NO: 1809 - DNA, 201 bp, Homo sapiens
gaggccgccttcctcgaggagaactgtgccgacatcaacttcagctgctgctacctctgcatccggctcgaggggctgccggctcccacggccagcccacrccctgggcccagcagcctcggccctggcctgaatgttgaccccggcacgtatacctgggtggcccacgggcagacgcaggactgggaccaggagcgccgg

SEQ ID NO: 1810 - DNA, 201 bp, Homo sapiens
tccggaagggccggctgcagcgtgtggggcttgagaggctcaccgccgaggcccggcacagccggctcttctgggtccaaattgtcctgtggcggcaaggsttctactacccgctgggcatcgtccgggaggtgctgcctgaggccagcacctgggagcagggcctccgcatcctcggcctggagtacagcttgagggtgc

SEQ ID NO: 1811 - DNA, 201 bp, Homo sapiens
ggtgcagttccagattgacccgatgaccttccgcctctggcaccaggcagtggacacactgcctgaggagcagctggtggtgcccgacttgcccacctgcrccctgcccagaccttggtctgtcccacccttgcggcgtggcaaccgcaagcaggagctggccgtggcgctcatcgcgggctggggccctggggatgggag

SEQ ID NO: 1812 - DNA, 201 bp, Homo sapiens
cggccgggcctgcggctcctgtggcggcgccgtgtctactcagcgcagggatccagcccgcccctgccactgcctggcactgtgccggacccacacaccckggccgtggagacggccctgtggaagcagctgctggagctggtggagctgcagcgctggccggaggcggctgctctcatccaggagaagggcgaggcgtcc

SEQ ID NO: 1813 - DNA, 201 bp, Homo sapiens
acccgggtgccggccgtgagctgccggcccgcctggactccgtggacgcctgcgtcgtggccgcgtgctacttctctcggctgctgcgccggcaccgcctrcggtccgactgcttctatgagcagccggacgaggacggcaccctgggcttccgcgcggcccacatcatggtgaaggagtacatgattcagtttaataggc

SEQ ID NO: 1814 - DNA, 201 bp, Homo sapiens
gtggagcggacggccgagcagacggccctgatggccaagtacaagggccctgccctggccctggagttcaaccgcagcagcgtggcctcgggccccatctygccaaccaactatcggcagaggatgcaccagtttctctatgaggaggaggcggctcagcagcagctggtggccaagctgaccctgcggggccaggtgttc

SEQ ID NO: 1815 - DNA, 201 bp, Homo sapiens
agctgggtggcctccagcggggggacctgctcacaccccctgcccctgatggcgacgggcgcacggccccccttggccagccccctggggcccagctgtaytgcccggcctgcttggtcacctgccactctcaggaggccttcgagaaccactgcgcatcctcggagcacgcacagatggtggccttcgaccaggccctgc

SEQ ID NO: 1816 - DNA, 201 bp, Homo sapiens
cgacgggcgcacggccccccttggccagccccctggggcccagctgtactgcccggcctgcttggtcacctgccactctcaggaggccttcgagaaccackgcgcatcctcggagcacgcacagatggtggccttcgaccaggccctgccctgggagcaccgttccccacccccgggactctccaagttcgagctctgccc

SEQ ID NO: 1817 - DNA, 201 bp, Homo sapiens
acatgtccatggcgtcctggctgaatctggctgagattgcgcaggtcgtcgagaaggtgcaggaggcctacaacacctggcccagctgctggggcggccgygagcagaggtgcatctgtgtcgtttcccacggtgcccagttccgggtcgtggtgctcagcactgtgcacacctgccagagcctgctcagccctggggcac

SEQ ID NO: 1818 - DNA, 201 bp, Homo sapiens
ttgcccacctgcgccctgcccagaccttggtctgtcccacccttgcggcgtggcaaccgcaagcaggagctggccgtggcgctcatcgcgggctggggccytggggatgggaggcgtgtccccccgctactcatctatggcccctttggcaccggcaagacctacacgctggccatggcctccctggaggtcatccggagg

SEQ ID NO: 1819 - DNA, 201 bp, Homo sapiens
tggagcggacggccgagcagacggccctgatggccaagtacaagggccctgccctggccctggagttcaaccgcagcagcgtggcctcgggccccatctcrccaaccaactatcggcagaggatgcaccagtttctctatgaggaggaggcggctcagcagcagctggtggccaagctgaccctgcggggccaggtgttcc

SEQ ID NO: 1820 - DNA, 201 bp, Homo sapiens
gcgcgaaggcagggcgctgcgttctatgcccccggcagggagccagtgcccatgctgccggccagcctctgccaggacgtcctcagcctcctgcctggccyggaccgcctggccatctccctgttcctcaccatggagaaggccagtggccagctgaagagcctgcgctttgcaccctccgtggtccagtctgaccgccag

SEQ ID NO: 1821 - DNA, 201 bp, Homo sapiens
tgcctgggccagcctgcctcctggcctcaggatctccctggggcaggaagtgggtggacttggaggaggaacggcaagggccggtccccacactcttgctyctcctgggcatctggggacaggaacacctctcagggtggccaagaggggcttccttgggaccagtgtaaggaagttctgctgtccctgggaagtctcaga

SEQ ID NO: 1822 - DNA, 201 bp, Homo sapiens
agcctgcctcctggcctcaggatctccctggggcaggaagtgggtggacttggaggaggaacggcaagggccggtccccacactcttgctcctcctgggcrtctggggacaggaacacctctcagggtggccaagaggggcttccttgggaccagtgtaaggaagttctgctgtccctgggaagtctcagaaccaggaagg

SEQ ID NO: 1823 - DNA, 201 bp, Homo sapiens
ggaacggcaagggccggtccccacactcttgctcctcctgggcatctggggacaggaacacctctcagggtggccaagaggggcttccttgggaccagtgyaaggaagttctgctgtccctgggaagtctcagaaccaggaaggaaaccctgtggaggctgccctttgacctttggacgccacctgtaatcactctggatg

SEQ ID NO: 1824 - DNA, 201 bp, Homo sapiens
aggctgccctttgacctttggacgccacctgtaatcactctggatggtgtctgtggagttcaggtttattttctatttaaatgaactaaaagccagcatcytgccgggcgtggtggctcacgcccataatccagcactttgggaagccgaggcgggcagatcacctgaggtcaggagttcgagaccatcctggccaacatg

SEQ ID NO: 1825 - DNA, 201 bp, Homo sapiens
tttattttctatttaaatgaactaaaagccagcatcctgccgggcgtggtggctcacgcccataatccagcactttgggaagccgaggcgggcagatcacytgaggtcaggagttcgagaccatcctggccaacatggtgaaaccccgtctccactaaaaatacaaaattagctgggcgtggtggcgggcgcctgtaatcc

SEQ ID NO: 1826 - DNA, 201 bp, Homo sapiens
gcctgtaatcccagctacttgggaggctgaggcaggagaatcgcttgactccaggaggcgcaggctgcagtgagctctgatggtaccactgcactccagcmtgggtgacagagcgagaccctgtcttaaaaaaaaaaacaaaacaaaaccagcatctgttactggaacagagacctcagcccaagctcaggacaaggaggc

SEQ ID NO: 1827 - DNA, 201 bp, Homo sapiens; identical to SEQ ID NO: 1758

SEQ ID NO: 1828 - DNA, 201 bp, Homo sapiens; identical to SEQ ID NO: 1759

SEQ ID NO: 1829 - DNA, 201 bp, Homo sapiens; identical to SEQ ID NO: 1760

SEQ ID NO: 1830 - DNA, 201 bp, Homo sapiens; identical to SEQ ID NO: 1761

SEQ ID NO: 1831 - DNA, 201 bp, Homo sapiens
aggttcctggagcggcagacctacaacatccccggaggccgccacaagctgaaccccagccagaacgtggcggtcagggaggctctggagaagcctttcayggtcattcagggcccaccaggtacagggaagacgatcgtgggcctccacatcgtattctggtttcataaatcaaaccaggagcaggtgcagcccggaggc

SEQ ID NO: 1832 - DNA, 201 bp, Homo sapiens; identical to SEQ ID NO: 1762

SEQ ID NO: 1833 - DNA, 201 bp, Homo sapiens; identical to SEQ ID NO: 1763

SEQ ID NO: 1834 - DNA, 201 bp, Homo sapiens; identical to SEQ ID NO: 1766

SEQ ID NO: 1835 - DNA, 201 bp, Homo sapiens; identical to SEQ ID NO: 1767

SEQ ID NO: 1836 - DNA, 201 bp, Homo sapiens; identical to SEQ ID NO: 1768

SEQ ID NO: 1837 - DNA, 201 bp, Homo sapiens
gtgcccaggtcagtgcactgaggcaggagctgaggaggcgggacctaggccaggtgtctgtcggcagttttgagatcctgccagggcggcagttccgggtygtggtgctcagcactgtgcacacctgccagagcctgctcagccctggggcactggcccctgagttcttcaccgacgcccgcgtgctcaacaccgtcctga

SEQ ID NO: 1838 - DNA, 201 bp, Homo sapiens; identical to SEQ ID NO: 1770

SEQ ID NO: 1839 - DNA, 201 bp, Homo sapiens; identical to SEQ ID NO: 1771

SEQ ID NO: 1840 - DNA, 201 bp, Homo sapiens; identical to SEQ ID NO: 1774

SEQ ID NO: 1841 - DNA, 201 bp, Homo sapiens; identical to SEQ ID NO: 1775

SEQ ID NO: 1842 - DNA, 201 bp, Homo sapiens
gcaagctgaagacgtggcagggcctgaggaggccgcccagtgtcctgggccacgctggcaaggagagctgccctgtcatctttggccacgtgcagggccaygagcggagcctgctggtgtccacggacgaagggaatgagaactccaaggccaacctggaggaggtggctgaggtggtccgtatcaccaagcagctgaccc

SEQ ID NO: 1843 - DNA, 201 bp, Homo sapiens; identical to SEQ ID NO: 1777

SEQ ID NO: 1844 - DNA, 106 bp, Homo sapiens
ctcacytctgacagccagacaagggctgtgctcaggggcagctcggctgggcacacagtaggtgctttagcggacagcactgaggcccccagcaagaagcccatga

SEQ ID NO: 1845 - DNA, 201 bp, Homo sapiens; identical to SEQ ID NO: 1779

SEQ ID NO: 1846 - DNA, 201 bp, Homo sapiens; identical to SEQ ID NO: 1781

SEQ ID NO: 1847 - DNA, 201 bp, Homo sapiens; identical to SEQ ID NO: 1782

SEQ ID NO: 1848 - DNA, 201 bp, Homo sapiens; identical to SEQ ID NO: 1783

SEQ ID NO: 1849 - DNA, 201 bp, Homo sapiens; identical to SEQ ID NO: 1786

SEQ ID NO: 1850 - DNA, 201 bp, Homo sapiens; identical to SEQ ID NO: 1787

SEQ ID NO: 1851 - DNA, 201 bp, Homo sapiens; identical to SEQ ID NO: 1788

SEQ ID NO: 1852 - DNA, 201 bp, Homo sapiens; identical to SEQ ID NO: 1790

SEQ ID NO: 1853 - DNA, 201 bp, Homo sapiens; identical to SEQ ID NO: 1791

SEQ ID NO: 1854 - DNA, 201 bp, Homo sapiens; identical to SEQ ID NO: 1792

SEQ ID NO: 1855 - DNA, 201 bp, Homo sapiens
ccctggggaggaccgtagagccccaggacatcgccgtcctcacgccctacaacgcgcaggcctctgagatcagcaaggcccttcggcgagagggcatcgcyggggtggccgtgtcctccatcaccaagagccaggggagcgagtggcgctatgtgctggtgagcaccgtccgcacctgtgccaagagcgacctggaccagc

SEQ ID NO: 1856 - DNA, 201 bp, Homo sapiens; identical to SEQ ID NO: 1795

SEQ ID NO: 1857 - DNA, 201 bp, Homo sapiens; identical to SEQ ID NO: 1797

SEQ ID NO: 1858 - DNA, 201 bp, Homo sapiens; identical to SEQ ID NO: 1798

SEQ ID NO: 1859 - DNA, 201 bp, Homo sapiens; identical to SEQ ID NO: 1803

SEQ ID NO: 1860 - DNA, 201 bp, Homo sapiens; identical to SEQ ID NO: 1804

SEQ ID NO: 1861 - DNA, 201 bp, Homo sapiens; identical to SEQ ID NO: 1805

SEQ ID NO: 1862 - DNA, 201 bp, Homo sapiens; identical to SEQ ID NO: 1806

SEQ ID NO: 1863 - DNA, 201 bp, Homo sapiens; identical to SEQ ID NO: 1807

SEQ ID NO: 1864 - DNA, 201 bp, Homo sapiens
gtcattcagggcccaccaggtacagggaagacgatcgtgggcctccacatcgtattctggtttcataaatcaaaccaggagcaggtgcagcccggaggccscccccgtggggagaagcggctggggggtccctgcatcttgtactgcggcccctccaacaagtcggtggatgtcctggcaggactgctcctgagaaggatg

SEQ ID NO: 1865 - DNA, 201 bp, Homo sapiens; identical to SEQ ID NO: 1809

SEQ ID NO: 1866 - DNA, 201 bp, Homo sapiens; identical to SEQ ID NO: 1810

SEQ ID NO: 1867 - DNA, 201 bp, Homo sapiens; identical to SEQ ID NO: 1812

SEQ ID NO: 1868 - DNA, 201 bp, Homo sapiens; identical to SEQ ID NO: 1813

SEQ ID NO: 1869 - DNA, 201 bp, Homo sapiens
tgctggtgtccacggacgaagggaatgagaactccaaggccaacctggaggaggtggctgaggtggtccgtatcaccaagcagctgaccctggggaggacygtagagccccaggacatcgccgtcctcacgccctacaacgcgcaggcctctgagatcagcaaggcccttcggcgagagggcatcgccggggtggccgtgt

SEQ ID NO: 1870 - DNA, 201 bp, Homo sapiens
acatgtccatggcgtcctggctgaatctggctgagattgcgcaggtcgtcgagaaggtgcaggaggcctacaacacctggcccagctgctggggcggccgygagcagaggtgcatctgtgtcgtttcccacggtgcccaggtcagtgcactgaggcaggagctgaggaggcgggacctaggccaggtgtctgtcggcagtt

SEQ ID NO: 1871 - DNA, 201 bp, Homo sapiens; identical to SEQ ID NO: 1820

SEQ ID NO: 1872 - DNA, 201 bp, Homo sapiens; identical to SEQ ID NO: 1821

SEQ ID NO: 1873 - DNA, 201 bp, Homo sapiens; identical to SEQ ID NO: 1822

SEQ ID NO: 1874 - DNA, 201 bp, Homo sapiens; identical to SEQ ID NO: 1823

SEQ ID NO: 1875 - DNA, 201 bp, Homo sapiens; identical to SEQ ID NO: 1824

SEQ ID NO: 1876 - DNA, 201 bp, Homo sapiens; identical to SEQ ID NO: 1825

SEQ ID NO: 1877 - DNA, 201 bp, Homo sapiens; identical to SEQ ID NO: 1826

SEQ ID NO: 1878 - DNA, 201 bp, Homo sapiens
gaaaccatccaggctttggaagaacttgctgccaaagagaaggctaatgaggatgctgtgccattgtgtatgtctgcagatttccccagggttgggatggsttcatcctacaacggacaagatgaagtggacattaagagcagagcagcatacaacgtaactttgctgaatttcatggatcctcagaaaatgccatacctg

SEQ ID NO: 1879 - DNA, 201 bp, Homo sapiens
aatgaggtcgagtttgagtggctgaggcagttttggtttcaaggcaatcgatacagaaagtgcactgactggtggtgtcaacccatggctcaactggaagyactgtggaagaagatggagggtgtgacaaatgctgtgcttcatgaagttaaaagagaggggctccccgtggaacaaaggaatgaaatcttgactgccatc

SEQ ID NO: 1880 - DNA, 201 bp, Homo sapiens
gcaccccgactgccgaggaacgagagcgcgaagctaagaaactgaggcttcttgaagagcttgaagacacttggctcccttatctgacccccaaagatgaygaattctatcagcagtggcagctgaaatatcctaaactaattctccgagaagccagcagtgtatctgaggagctccataaagaggttcaagaagcctttc

SEQ ID NO: 1881 - DNA, 201 bp, Homo sapiens
tgttaaacaggaccttcttcccccaaaattgttcagattataaaatgtgagccattcagcccccaaggtccagggcaggcgacaggaacgagcccagcgtrtgacaaagcctaacctactttcctctttcccaagctttttcagagactctggagtggacccagccctctggggaaagacagaacttagagacatcccagt

SEQ ID NO: 1882 - DNA, 201 bp, Homo sapiens
agctcttcagtcgccctggccacatttcaagtgcttaacagcctcatgtggctagtgactgctgtattggacggtacagatatggaacattttcatcatcraagaaagtcctattggacaacacttctataaaaagtttgagagcaggaattctcatttccattcgtctgtagcttctatccccaaaggcaaagaaactaa

SEQ ID NO: 1883 - DNA, 201 bp, Homo sapiens
ctcttcagtcgccctggccacatttcaagtgcttaacagcctcatgtggctagtgactgctgtattggacggtacagatatggaacattttcatcatcgawgaaagtcctattggacaacacttctataaaaagtttgagagcaggaattctcatttccattcgtctgtagcttctatccccaaaggcaaagaaactaaaa

SEQ ID NO: 1884 - DNA, 201 bp, Homo sapiens
cgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctg

SEQ ID NO: 1885 - DNA, 159 bp, Homo sapiens
tatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcac

SEQ ID NO: 1886 - DNA, 201 bp, Homo sapiens
aattcggattgagatcatagctctaagccttaatgattctcaagtaaccatggatgacactatccaacggctgtttgttgagtgtcgattctacagtcttsctgctgaagagacacccgtgtcacttccaaaacccaagagtgggcagtgggtctactataactatagcaatgtgatctacgtggataaagaaaacaacaa

SEQ ID NO: 1887 - DNA, 201 bp, Homo sapiens
tttttgatgcacgagcagatggtgaaggtattggcaagctcagggtaacagtcgaagctctccatgccctccagtctgtctacaagcaatacagagatgayttggaggcttgaaagcaaatgctccagaggcatctcctactcctcagtaaatgctcacatgaaagttcctacatgagatttttgtaattactctggtgta

SEQ ID NO: 1888 - DNA, 201 bp, Homo sapiens
atatggcaacagtttacttgaagaagccagaggagaaataagaaatttagaaaacgttattcagtcacaaagaggccagatagaggagttagagcacttgrctgagatcctgaaaactcagttgaggagaaaagaaaatgaaattgagttatctcttcttcagcttcgagaacagcaagctacagatcaaaggtcaaatat

SEQ ID NO: 1889 - DNA, 201 bp, Homo sapiens
gcctaatagaagccttcgcttcaccgtggtcagtgaccctccagaggacgagcaggacctggagtgtgaggacattggcgtggctcacgtcgaccttgccracatgtttcaggaagggagggacctcattgagcaaaatatcgatgtttttgatgcacgagcagatggtgaaggtattggcaagctcagggtaacagtcga

SEQ ID NO: 1890 - DNA, 201 bp, Homo sapiens
tttagcaccaagacctaaaccaagacaacgtttaacacctgtagataagaaggtatctttcgtggatatcatgccacatcagagtgatgtttcacaagaargcagtgtagatgaggtaaaagagaatactgagaaaatgcagcaaggaaaagatgatgtgtctttactatctgaaggtcagcttgcagaacaaagcttggc

SEQ ID NO: 1891 - DNA, 201 bp, Homo sapiens
ttttgtacagcaagtttgattggaacaaaaggagacatcccaaattttggcacagtggaatactggttccgattaagagttcccatggatcaagcaattcractttatcgagaaagggcaaaggctttggggtatataacatcaaattttaaggggccagagcatatgcagtcgttaagtcagcaagcacccaaaactgct

SEQ ID NO: 1892 - DNA, 201 bp, Homo sapiens
cagagtctctgagtttttatgtttttgatgatagtgatacccaggagaatatttacataggaaaagtcaatgtgcctctgatttcgttggcacatgacagrtgtatctcaggaatatttgagttaacagaccatcaaaagcatcctgctggcaccatccatgttatattgaaatggaaatttgcttaccttccaccaagtg

SEQ ID NO: 1893 - DNA, 201 bp, Homo sapiens
gagatcaaaatgaaaaactcgttcaagagaatagagaactacagttacagtatctggaacaaaagcaacaacttgatgaacttaaaaaacgcataaaattrtacaaccaggagaatgatattaatgctgatgaattgagtgaagctctcctacttataaaggctcaaaaagaacaaaaaaatggagacctttcctttttag

SEQ ID NO: 1894 - DNA, 201 bp, Homo sapiens
gtcagcttgcagaacaaagcttggcatcttctgaagatgaaacagaaataacagaggacttggaaccagaagttgaagaggacatgtcagcttctgacagygatgactgtattattccaggtcctatctccaagaatatcaaacagccatcagaaaaaattcggattgagatcatagctctaagccttaatgattctcaag

SEQ ID NO: 1895 - DNA, 201 bp, Homo sapiens
cctccagtctgtctacaagcaatacagagatgacttggaggcttgaaagcaaatgctccagaggcatctcctactcctcagtaaatgctcacatgaaagtwcctacatgagatttttgtaattactctggtgtatataatctataattcatgggaagctgggagcggggagacctgggtttgaagtgttgaagttttgtat

SEQ ID NO: 1896 - DNA, 201 bp, Homo sapiens
atgttatccctaatcgtcccactaaatggaatgcctatgattagcttcattaagagttttatactgtgaagattttattagaagcaatatatgaaaattasttggattaatgtgttaatcttcctctttaaaatgctaatatccattttatgcacattaaagctcagtatgcattttctttgatgcatgcagtttctatca

SEQ ID NO: 1897 - DNA, 201 bp, Homo sapiens
gcaagttttttgtctttctttcttaaaagttcattctatttgtattattttcatacatttgtaatggtgacccagggatgtatatataaaaaggagatagktatatagatagatgtgaaatttacacgttgaaaacttagtatatgacacagaaagaaattatgaaaagtataactcaaattctgatatgcttagttagac

SEQ ID NO: 1898 - DNA, 102 bp, Homo sapiens
actgggcctccctgtcctggggcctgccatctccgagaagaatcttgctctcatccaactctgcaaatcttcataacaactcgttcctctggaaccttctrg

SEQ ID NO: 1899 - DNA, 201 bp, Homo sapiens
aaacctgcaagaaattttcaaatccatacagtattgagtattctgaacttgactgtgaggaagggtggacacaactgaagtgtggaagaaatgaaagggcraaggtgtgttttgagaaggctctggaagaaaagcccaacaacccagaattctcctctggactggcaattgcgatgtaccatctggataatcacccagaga

SEQ ID NO: 1900 - DNA, 201 bp, Homo sapiens
aagcactaaagcaatatgctatggactattcgaataaagctcttgagaagggactgaatcctctgaatgcatactccgatctcgctgagttcctggagacrgaatgttatcagacaccattcaataaggaagtccctgatgctgaaaagcaacaatcccatcagcgctactgcaaccttcagaaatataatgggaagtctg

SEQ ID NO: 1901 - DNA, 201 bp, Homo sapiens
ccctggaatgcttacggcaagctgaagagttaatccagcaagaacatgctgaccaagcagaaatcagaagtctagtcacttggggaaactacgcctgggtytactatcacttgggcagactctcagatgctcagatttatgtagataaggtgaaacaaacctgcaagaaattttcaaatccatacagtattgagtattctg

SEQ ID NO: 1902 - DNA, 201 bp, Homo sapiens
agctgaagagttaatccagcaagaacatgctgaccaagcagaaatcagaagtctagtcacttggggaaactacgcctgggtctactatcacttgggcagaytctcagatgctcagatttatgtagataaggtgaaacaaacctgcaagaaattttcaaatccatacagtattgagtattctgaacttgactgtgaggaagg

SEQ ID NO: 1903 - DNA, 201 bp, Homo sapiens
catcagcgctactgcaaccttcagaaatataatgggaagtctgaagacactgctgtgcaacatggtttagagggtttgtccataagcaaaaaatcaactgrcaaggaagagatcaaagaccaaccacagaatgtatctgaaaatctgcttccacaaaatgcaccaaattattggtatcttcaaggattaattcataagcag

SEQ ID NO: 1904 - DNA, 201 bp, Homo sapiens
tgccctactctcccacccctttatatagttccttcagtatttacttgaggcagacaggaagacttctgaagaacaaatcagcctggtcaccagcttttcgsaacagcagagacacagagggcagtcatgagtgaggtcaccaagaattccctggagaaaatccttccacagctgaaatgccatttcacctggaacttattc

SEQ ID NO: 1905 - DNA, 143 bp, Homo sapiens
aaaacatcagctgatgcgtgccctactctcccacccctttatrtagttccttcagtatttacttgaggcagacaggaagacttctgaagaacaaatcagcctggtcaccagcttttcggaacagcagagacacagagggcagt

SEQ ID NO: 1906 - DNA, 201 bp, Homo sapiens
tttatgtagataaggtgaaacaaacctgcaagaaattttcaaatccatacagtattgagtattctgaacttgactgtgaggaagggtggacacaactgaartgtggaagaaatgaaagggcgaaggtgtgttttgagaaggctctggaagaaaagcccaacaacccagaattctcctctggactggcaattgcgatgtacc

SEQ ID NO: 1907 - DNA, 201 bp, Homo sapiens
gtttagagggtttgtccataagcaaaaaatcaactgacaaggaagagatcaaagaccaaccacagaatgtatctgaaaatctgcttccacaaaatgcaccraattattggtatcttcaaggattaattcataagcagaatggagatctgctgcaagcagccaaatgttatgagaaggaactgggccgcctgctaagggatg

SEQ ID NO: 1908 - DNA, 201 bp, Homo sapiens
agtctgaagacactgctgtgcaacatggtttagagggtttgtccataagcaaaaaatcaactgacaaggaagagatcaaagaccaaccacagaatgtatcygaaaatctgcttccacaaaatgcaccaaattattggtatcttcaaggattaattcataagcagaatggagatctgctgcaagcagccaaatgttatgaga

SEQ ID NO: 1909 - DNA, 201 bp, Homo sapiens
caaatccatacagtattgagtattctgaacttgactgtgaggaagggtggacacaactgaagtgtggaagaaatgaaagggcgaaggtgtgttttgagaargctctggaagaaaagcccaacaacccagaattctcctctggactggcaattgcgatgtaccatctggataatcacccagagaaacagttctctactgatg

SEQ ID NO: 1910 - DNA, 201 bp, Homo sapiens
cagtcccagagagctcctctctaactcagagcaactgaactgagacagaggaggaaaacagagcatcagaagcctgcagtggtggttgtgacgggtaggasgataggaagacagggggccccaacctgggattgctgagcagggaagctttgcatgttgctctaaggtacatttttaaagagttgttttttggccgggcgc

SEQ ID NO: 1911 - DNA, 201 bp, Homo sapiens
gaggataggaagacagggggccccaacctgggattgctgagcagggaagctttgcatgttgctctaaggtacatttttaaagagttgttttttggccgggygcagtggctcatgcctgtaatcccagcactttgggaggccgaggtgggcggatcacgaggtctggagtttgagaccatcctggctaacacagtgaaatcc

SEQ ID NO: 1912 - DNA, 201 bp, Homo sapiens
ctgggattgctgagcagggaagctttgcatgttgctctaaggtacatttttaaagagttgttttttggccgggcgcagtggctcatgcctgtaatcccagmactttgggaggccgaggtgggcggatcacgaggtctggagtttgagaccatcctggctaacacagtgaaatcccgtctctactaaaaatacaaaaaatta

SEQ ID NO: 1913 - DNA, 201 bp, Homo sapiens
gcagtggctcatgcctgtaatcccagcactttgggaggccgaggtgggcggatcacgaggtctggagtttgagaccatcctggctaacacagtgaaatccygtctctactaaaaatacaaaaaattagccaggcgtggtggctggcacctgtagtcccagctacttgggaggctgaggcaggagaatggcgtgaacctgga

SEQ ID NO: 1914 - DNA, 201 bp, Homo sapiens
ggtgggcggatcacgaggtctggagtttgagaccatcctggctaacacagtgaaatcccgtctctactaaaaatacaaaaaattagccaggcgtggtggckggcacctgtagtcccagctacttgggaggctgaggcaggagaatggcgtgaacctggaaggaagaggttgcagtgagccaagattgcgcccctgcactcc

SEQ ID NO: 1915 - DNA, 201 bp, Homo sapiens
tacaaaaaattagccaggcgtggtggctggcacctgtagtcccagctacttgggaggctgaggcaggagaatggcgtgaacctggaaggaagaggttgcartgagccaagattgcgcccctgcactccagcctgggcaacagagcaagactccatctcaaaaaaaaaaaaaaaaaaaaaaaagagttgttttctcatgttc

SEQ ID NO: 1916 - DNA, 201 bp, Homo sapiens
acaaaaaattagccaggcgtggtggctggcacctgtagtcccagctacttgggaggctgaggcaggagaatggcgtgaacctggaaggaagaggttgcagwgagccaagattgcgcccctgcactccagcctgggcaacagagcaagactccatctcaaaaaaaaaaaaaaaaaaaaaaaagagttgttttctcatgttca

SEQ ID NO: 1917 - DNA, 201 bp, Homo sapiens; identical to SEQ ID NO: 1899

SEQ ID NO: 1918 - DNA, 201 bp, Homo sapiens; identical to SEQ ID NO: 1900

SEQ ID NO: 1919 - DNA, 201 bp, Homo sapiens; identical to SEQ ID NO: 1901

SEQ ID NO: 1920 - DNA, 201 bp, Homo sapiens; identical to SEQ ID NO: 1902

SEQ ID NO: 1921 - DNA, 201 bp, Homo sapiens; identical to SEQ ID NO: 1903

SEQ ID NO: 1922 - DNA, 201 bp, Homo sapiens; identical to SEQ ID NO: 1906

SEQ ID NO: 1923 - DNA, 201 bp, Homo sapiens; identical to SEQ ID NO: 1907

SEQ ID NO: 1924 - DNA, 201 bp, Homo sapiens; identical to SEQ ID NO: 1908

SEQ ID NO: 1925 - DNA, 111 bp, Homo sapiens
gacctaacagyaccctgggtggaaacctcttcagcatttgcttggaatcagtaagctaaaaacaaaatcaaccgggaccccagcttttcagaactgcagggaaacagccat

SEQ ID NO: 1926 - DNA, 201 bp, Homo sapiens; identical to SEQ ID NO: 1909

SEQ ID NO: 1927 - DNA, 201 bp, Homo sapiens; identical to SEQ ID NO: 1910

SEQ ID NO: 1928 - DNA, 201 bp, Homo sapiens; identical to SEQ ID NO: 1911

SEQ ID NO: 1929 - DNA, 201 bp, Homo sapiens; identical to SEQ ID NO: 1912

SEQ ID NO: 1930 - DNA, 201 bp, Homo sapiens; identical to SEQ ID NO: 1913

SEQ ID NO: 1931 - DNA, 201 bp, Homo sapiens; identical to SEQ ID NO: 1914

SEQ ID NO: 1932 - DNA, 201 bp, Homo sapiens; identical to SEQ ID NO: 1915

SEQ ID NO: 1933 - DNA, 201 bp, Homo sapiens; identical to SEQ ID NO: 1916

SEQ ID NO: 1934 - DNA, 201 bp, Homo sapiens
caagtgtattatgtgggtcattctcaaggcaccactataggttttatagcattttcacagatccctgagctggctaaaaggattaaaatgttttttgcccygggtcctgtggcttccgtcgccttctgtactagccctatggccaaattaggacgattaccagatcatctcattaaggacttatttggagacaaagaattt

SEQ ID NO: 1935 - DNA, 201 bp, Homo sapiens
tatcctcccacatacaatgtgaaggacatgcttgtgccgactgcagtctggagcgggggtcacgactggcttgcagatgtctacgacgtcaatatcttacygactcagatcaccaacttggtgttccatgagagcattccggaatgggagcatcttgacttcatttggggcctggatgccccttggaggctttataataaa

SEQ ID NO: 1936 - DNA, 201 bp, Homo sapiens
tctgtttggttctctggaccctgcattctgaggggtctggagggaaactgacagctgtggatcctgaaacaaacatgaatgtgagtgaaattatctcttastggggattccctagtgaggaatacctagttgagacagaagatggatatattctgtgccttaaccgaattcctcatgggaggaagaaccattctgacaaag

SEQ ID NO: 1937 - DNA, 201 bp, Homo sapiens
gttttgacgtgtggatgggcaacagcagaggaaatacctggtctcggaaacataagacactctcagtttctcaggatgaattctgggctttcagttatgawgagatggcaaaatatgacctaccagcttccattaacttcattctgaataaaactggccaagaacaagtgtattatgtgggtcattctcaaggcaccacta

SEQ ID NO: 1938 - DNA, 201 bp, Homo sapiens
gtgccttaaccgaattcctcatgggaggaagaaccattctgacaaaggtcccaaaccagttgtcttcctgcaacatggcttgctggcagattctagtaacwgggtcacaaaccttgccaacagcagcctgggcttcattcttgctgatgctggttttgacgtgtggatgggcaacagcagaggaaatacctggtctcggaa

SEQ ID NO: 1939 - DNA, 201 bp, Homo sapiens
tgttttcttctgtgtggatttaatgagagaaatttaaatatgtctagagtggatgtatatacaacacattctcctgctggaacttctgtgcaaaacatgtyacactggagccaggctgttaaattccaaaagtttcaagcctttgactggggaagcagtgccaagaattattttcattacaaccagagttatcctcccaca

SEQ ID NO: 1940 - DNA, 201 bp, Homo sapiens
ttttcttctgtgtggatttaatgagagaaatttaaatatgtctagagtggatgtatatacaacacattctcctgctggaacttctgtgcaaaacatgttayactggagccaggctgttaaattccaaaagtttcaagcctttgactggggaagcagtgccaagaattattttcattacaaccagagttatcctcccacata

SEQ ID NO: 1941 - DNA, 201 bp, Homo sapiens
actcgagacagcggcccggcaggacagctccagaatgaaaatgcggttcttggggttggtggtctgtttggttctctggaccctgcattctgaggggtctrgagggaaactgacagctgtggatcctgaaacaaacatgaatgtgagtgaaattatctcttactggggattccctagtgaggaatacctagttgagacaga

SEQ ID NO: 1942 - DNA, 201 bp, Homo sapiens
ccagcctgcgaggcggaggacgggctccatctcttagaaacgcctacggcgcatgctctatggggtcaactggggggctggcaagcggcagcgctggtctrgggcggagtctccgaggcacttcccggtggctggctgctctgattggctgaacaaatagtccgagggtggtgggcatccgccctcccgacaaggcagacc

SEQ ID NO: 1943 - DNA, 201 bp, Homo sapiens
aaaacatgttacactggagccaggctgttaaattccaaaagtttcaagcctttgactggggaagcagtgccaagaattattttcattacaaccagagttawcctcccacatacaatgtgaaggacatgcttgtgccgactgcagtctggagcgggggtcacgactggcttgcagatgtctacgacgtcaatatcttactga

SEQ ID NO: 1944 - DNA, 201 bp, Homo sapiens
ttcctgcaacatggcttgctggcagattctagtaactgggtcacaaaccttgccaacagcagcctgggcttcattcttgctgatgctggttttgacgtgtrgatgggcaacagcagaggaaatacctggtctcggaaacataagacactctcagtttctcaggatgaattctgggctttcagttatgatgagatggcaaaa

SEQ ID NO: 1945 - DNA, 201 bp, Homo sapiens
tgactggggaagcagtgccaagaattattttcattacaaccagagttatcctcccacatacaatgtgaaggacatgcttgtgccgactgcagtctggagcrggggtcacgactggcttgcagatgtctacgacgtcaatatcttactgactcagatcaccaacttggtgttccatgagagcattccggaatgggagcatct

SEQ ID NO: 1946 - DNA, 201 bp, Homo sapiens
tattatgtgggtcattctcaaggcaccactataggttttatagcattttcacagatccctgagctggctaaaaggattaaaatgttttttgccctgggtcytgtggcttccgtcgccttctgtactagccctatggccaaattaggacgattaccagatcatctcattaaggacttatttggagacaaagaatttcttccc

SEQ ID NO: 1947 - DNA, 201 bp, Homo sapiens
ctgtggacctgccagcctgcgaggcggaggacgggctccatctcttagaaacgcctacggcgcatgctctatggggtcaactggggggctggcaagcggcmgcgctggtctggggcggagtctccgaggcacttcccggtggctggctgctctgattggctgaacaaatagtccgagggtggtgggcatccgccctcccga

SEQ ID NO: 1948 - DNA, 158 bp, Homo sapiens
atgcgtaggcgacgcgctggtagagctgtggacctgccagcctgcgaggcggaggacsggctccatctcttagaaacgcctacggcgcatgctctatggggtcaactggggggctggcaagcggcagcgctggtctggggcggagtctccgaggcact

SEQ ID NO: 1949 - DNA, 201 bp, Homo sapiens
cccctgagagctggcactgcgactcgagacagcggcccggcaggacagctccagaatgaaaatgcggttcttggggttggtggtctgtttggttctctggmccctgcattctgaggggtctggagggaaactgacagctgtggatcctgaaacaaacatgaatgtgagtgaaattatctcttactggggattccctagtga

SEQ ID NO: 1950 - DNA, 201 bp, Homo sapiens
gtcacaaaccttgccaacagcagcctgggcttcattcttgctgatgctggttttgacgtgtggatgggcaacagcagaggaaatacctggtctcggaaacvtaagacactctcagtttctcaggatgaattctgggctttcagttatgatgagatggcaaaatatgacctaccagcttccattaacttcattctgaataaa

SEQ ID NO: 1951 - DNA, 201 bp, Homo sapiens
tgaaacaaacatgaatgtgagtgaaattatctcttactggggattccctagtgaggaatacctagttgagacagaagatggatatattctgtgccttaacygaattcctcatgggaggaagaaccattctgacaaaggtcccaaaccagttgtcttcctgcaacatggcttgctggcagattctagtaactgggtcacaaa

SEQ ID NO: 1952 - DNA, 201 bp, Homo sapiens
gagacagaagatggatatattctgtgccttaaccgaattcctcatgggaggaagaaccattctgacaaaggtcccaaaccagttgtcttcctgcaacatgkcttgctggcagattctagtaactgggtcacaaaccttgccaacagcagcctgggcttcattcttgctgatgctggttttgacgtgtggatgggcaacagc

SEQ ID NO: 1953 - DNA, 201 bp, Homo sapiens
atttcttccccagagtgcgtttttgaagtggctgggtacccacgtttgcactcatgtcatactgaaggagctctgtggaaatctctgttttcttctgtgtkgatttaatgagagaaatttaaatatgtctagagtggatgtatatacaacacattctcctgctggaacttctgtgcaaaacatgttacactggagccaggc

SEQ ID NO: 1954 - DNA, 201 bp, Homo sapiens
ctctgtggaaatctctgttttcttctgtgtggatttaatgagagaaatttaaatatgtctagagtggatgtatatacaacacattctcctgctggaacttstgtgcaaaacatgttacactggagccaggctgttaaattccaaaagtttcaagcctttgactggggaagcagtgccaagaattattttcattacaaccag

SEQ ID NO: 1955 - DNA, 201 bp, Homo sapiens
aaaatgttttttgccctgggtcctgtggcttccgtcgccttctgtactagccctatggccaaattaggacgattaccagatcatctcattaaggacttatytggagacaaagaatttcttccccagagtgcgtttttgaagtggctgggtacccacgtttgcactcatgtcatactgaaggagctctgtggaaatctctgt

SEQ ID NO: 1956 - DNA, 201 bp, Homo sapiens
gggagcatcttgacttcatttggggcctggatgccccttggaggctttataataaaattattaatctaatgaggaaatatcagtgaaagctggacttgagytgtgtaccaccaagtcaatgattatgtcatgtgaaaatgtgtttgcttcatttctgtaaaacacttgtttttctttcccaggtcttttgtttttttatat

SEQ ID NO: 1957 - DNA, 201 bp, Homo sapiens
tggtaaatctgtcactgacttaagcgaggtataaaagtacgcagttttcatgtccttgccttaaagagctctctagtctaacggtcttgtagttagagatytaaatgacattttatcatgttttcctgcagcaggtgcatagtcaaatccagaaatatcacagctgtgccagtaataaggatgctaacaattaattttatc

SEQ ID NO: 1958 - DNA, 201 bp, Homo sapiens
caggtgcatagtcaaatccagaaatatcacagctgtgccagtaataaggatgctaacaattaattttatcaaacctaactgtgacagctgtgatttgacaygttttaattgctcaggttaaatgaaatagttttccggcgtcttcaaaaacaaattgcactgataaaacaaaaacaaaagtatgttttaaatgctttgaag

SEQ ID NO: 1959 - DNA, 201 bp, Homo sapiens
attttttctgagattaatgtactcttggagcccgctactgtcgttattgatcacatctgtgtgaagccaaagccccgtggttgcccatgagaagtgtcctwgttcattttcacccaaatgaagtgtgaacgtgatgttttcggatgcaaactcagctcagggattcattttgtgtcttagttttatatgcatccttatttt

SEQ ID NO: 1960 - DNA, 201 bp, Homo sapiens
atatgcatccttatttttaatacacctgcttcacgtccctatgttgggaagtccatatttgtctgcttttcttgcagcatcatttccttacaatactgtcyggtggacaaaatgacaattgatatgtttttctgatataattactttagctgcactaacagtacaatgcttgttaatggttaatataggcagggcgaatac

SEQ ID NO: 1961 - DNA, 201 bp, Homo sapiens; identical to SEQ ID NO: 1934

SEQ ID NO: 1962 - DNA, 130 bp, Homo sapiens
attgtcagctcctgattctgcagaaaacaygaaactgagctgtacaaagatgctgatgaggggctgcagcatgcaattcacttcaccagcagtcactaagaatgaaaatgcggttcttggggttggtggt

SEQ ID NO: 1963 - DNA, 201 bp, Homo sapiens; identical to SEQ ID NO: 1935

SEQ ID NO: 1964 - DNA, 201 bp, Homo sapiens; identical to SEQ ID NO: 1936

SEQ ID NO: 1965 - DNA, 201 bp, Homo sapiens; identical to SEQ ID NO: 1937

SEQ ID NO: 1966 - DNA, 201 bp, Homo sapiens; identical to SEQ ID NO: 1938

SEQ ID NO: 1967 - DNA, 201 bp, Homo sapiens; identical to SEQ ID NO: 1939

SEQ ID NO: 1968 - DNA, 201 bp, Homo sapiens; identical to SEQ ID NO: 1940

SEQ ID NO: 1969 - DNA, 201 bp, Homo sapiens
agcatgcaattcacttcaccagcagtcactaagaatgaaaatgcggttcttggggttggtggtctgtttggttctctggaccctgcattctgaggggtctrgagggaaactgacagctgtggatcctgaaacaaacatgaatgtgagtgaaattatctcttactggggattccctagtgaggaatacctagttgagacaga

SEQ ID NO: 1970 - DNA, 201 bp, Homo sapiens; identical to SEQ ID NO: 1943

SEQ ID NO: 1971 - DNA, 201 bp, Homo sapiens; identical to SEQ ID NO: 1944

SEQ ID NO: 1972 - DNA, 201 bp, Homo sapiens; identical to SEQ ID NO: 1945

SEQ ID NO: 1973 - DNA, 201 bp, Homo sapiens; identical to SEQ ID NO: 1946

SEQ ID NO: 1974 - DNA, 201 bp, Homo sapiens
aagatgctgatgaggggctgcagcatgcaattcacttcaccagcagtcactaagaatgaaaatgcggttcttggggttggtggtctgtttggttctctggmccctgcattctgaggggtctggagggaaactgacagctgtggatcctgaaacaaacatgaatgtgagtgaaattatctcttactggggattccctagtga

SEQ ID NO: 1975 - DNA, 201 bp, Homo sapiens; identical to SEQ ID NO: 1950

SEQ ID NO: 1976 - DNA, 201 bp, Homo sapiens; identical to SEQ ID NO: 1951

SEQ ID NO: 1977 - DNA, 201 bp, Homo sapiens; identical to SEQ ID NO: 1952

SEQ ID NO: 1978 - DNA, 201 bp, Homo sapiens; identical to SEQ ID NO: 1953

SEQ ID NO: 1979 - DNA, 201 bp, Homo sapiens; identical to SEQ ID NO: 1954

SEQ ID NO: 1980 - DNA, 201 bp, Homo sapiens; identical to SEQ ID NO: 1955

SEQ ID NO: 1981 - DNA, 201 bp, Homo sapiens; identical to SEQ ID NO: 1956

SEQ ID NO: 1982 - DNA, 201 bp, Homo sapiens; identical to SEQ ID NO: 1934

SEQ ID NO: 1983 - DNA, 201 bp, Homo sapiens; identical to SEQ ID NO: 1935

SEQ ID NO: 1984 - DNA, 201 bp, Homo sapiens; identical to SEQ ID NO: 1936

SEQ ID NO: 1985 - DNA, 201 bp, Homo sapiens; identical to SEQ ID NO: 1937

SEQ ID NO: 1986 - DNA, 201 bp, Homo sapiens; identical to SEQ ID NO: 1938

SEQ ID NO: 1987 - DNA, 201 bp, Homo sapiens; identical to SEQ ID NO: 1939

SEQ ID NO: 1988 - DNA, 201 bp, Homo sapiens; identical to SEQ ID NO: 1940

SEQ ID NO: 1989 - DNA, 201 bp, Homo sapiens
ggcaggacagctccagactgttttattatacagaatgaaaatgcggttcttggggttggtggtctgtttggttctctggaccctgcattctgaggggtctrgagggaaactgacagctgtggatcctgaaacaaacatgaatgtgagtgaaattatctcttactggggattccctagtgaggaatacctagttgagacaga

SEQ ID NO: 1990 - DNA, 201 bp, Homo sapiens; identical to SEQ ID NO: 1943

SEQ ID NO: 1991 - DNA, 201 bp, Homo sapiens; identical to SEQ ID NO: 1944

SEQ ID NO: 1992 - DNA, 201 bp, Homo sapiens; identical to SEQ ID NO: 1945

SEQ ID NO: 1993 - DNA, 201 bp, Homo sapiens; identical to SEQ ID NO: 1946

SEQ ID NO: 1994 - DNA, 201 bp, Homo sapiens
tgcgactcgagacagcggcccggcaggacagctccagactgttttattatacagaatgaaaatgcggttcttggggttggtggtctgtttggttctctggmccctgcattctgaggggtctggagggaaactgacagctgtggatcctgaaacaaacatgaatgtgagtgaaattatctcttactggggattccctagtga

SEQ ID NO: 1995 - DNA, 201 bp, Homo sapiens; identical to SEQ ID NO: 1950

SEQ ID NO: 1996 - DNA, 201 bp, Homo sapiens; identical to SEQ ID NO: 1951

SEQ ID NO: 1997 - DNA, 201 bp, Homo sapiens; identical to SEQ ID NO: 1952

SEQ ID NO: 1998 - DNA, 201 bp, Homo sapiens; identical to SEQ ID NO: 1953

SEQ ID NO: 1999 - DNA, 201 bp, Homo sapiens; identical to SEQ ID NO: 1954

SEQ ID NO: 2000 - DNA, 201 bp, Homo sapiens; identical to SEQ ID NO: 1955

SEQ ID NO: 2001 - DNA, 201 bp, Homo sapiens; identical to SEQ ID NO: 1956

SEQ ID NO: 2002 - DNA, 201 bp, Homo sapiens; identical to SEQ ID NO: 1957

SEQ ID NO: 2003 - DNA, 201 bp, Homo sapiens; identical to SEQ ID NO: 1958

SEQ ID NO: 2004 - DNA, 201 bp, Homo sapiens; identical to SEQ ID NO: 1959

SEQ ID NO: 2005 - DNA, 201 bp, Homo sapiens; identical to SEQ ID NO: 1960

SEQ ID NO: 2006 - DNA, 201 bp, Homo sapiens
tctagaacaagagaactaaaagcactccatttggttcctcagtatcaagatcaaaataattatctacagtcagatgtccctaaaccaatgactgctttagyagggagatttttgccagcatcaacaaaattaaatctcattacacaacaacttgagggagccttaccatcggtagtcaacgggtctgctttcccctcggga

SEQ ID NO: 2007 - DNA, 201 bp, Homo sapiens
cccatcgtcccaggaactagaggatgcctcctgctgttctcttaagaaagattccaacccaatggtgatatgccaattgaaagggggcacacaaatgctaygtatagacaattctagaacaagagaactaaaagcactccatttggttcctcagtatcaagatcaaaataattatctacagtcagatgtccctaaaccaat

SEQ ID NO: 2008 - DNA, 201 bp, Homo sapiens
agagtgtctgcagggcggcggagggcagagcagggcaggggagggcacagcaggccctgcgaagggcagagcggggcaggggagggcagagcaggccctgyggagagctcactctggtcgactcttcctctcagagaatgttgctctggaggctgctctgcatgaaaaccctaatggtttcttgtttgtttttcaaattat

SEQ ID NO: 2009 - DNA, 201 bp, Homo sapiens; identical to SEQ ID NO: 2006

SEQ ID NO: 2010 - DNA, 201 bp, Homo sapiens; identical to SEQ ID NO: 2007

SEQ ID NO: 2011 - DNA, 201 bp, Homo sapiens
atggcctgagcattgtttgtctggcccagaggagagagcttgggttcccatagtcctgggagagtgtctgcagggcggcggagggcagaagcaggccctgyggagagctcactctggtcgactcttcctctcagagaatgttgctctggaggctgctctgcatgaaaaccctaatggtttcttgtttgtttttcaaattat

SEQ ID NO: 2012 - DNA, 201 bp, Homo sapiens; identical to SEQ ID NO: 2008

SEQ ID NO: 2013 - DNA, 201 bp, Homo sapiens
tcaccagcagagccgccatccacaggatctccctcgagaccaataacaacgacgtggccatcccgctcacgggcgtcaaggaggcctcagccctggacttygatgtgtccaacaaccacatctactggacagacgtcagcctgaagaccatcagccgcgccttcatgaacgggagctcggtggagcacgtggtggagtttg

SEQ ID NO: 2014 - DNA, 201 bp, Homo sapiens
gctcggtggagcacgtggtggagtttggccttgactaccccgagggcatggccgttgactggatgggcaagaacctctactgggccgacactgggaccaayagaatcgaagtggcgcggctggacgggcagttccggcaagtcctcgtgtggagggacttggacaacccgaggtcgctggccctggatcccaccaagggct

SEQ ID NO: 2015 - DNA, 201 bp, Homo sapiens
ccccgagccatcgcactgcaccccgtgatgggcctcatgtactggacagactggggagagaaccctaaaatcgagtgtgccaacttggatgggcaggagcrgcgtgtgctggtcaatgcctccctcgggtggcccaacggcctggccctggacctgcaggaggggaagctctactggggagacgccaagacagacaagatc

SEQ ID NO: 2016 - DNA, 201 bp, Homo sapiens
tggcatcgcggtcgactgggtggcccgaaacctctactggaccgacacgggcacggaccgcatcgaggtgacgcgcctcaacggcacctcccgcaagatcytggtgtcggaggacctggacgagccccgagccatcgcactgcaccccgtgatgggcctcatgtactggacagactggggagagaaccctaaaatcgagtg

SEQ ID NO: 2017 - DNA, 201 bp, Homo sapiens
agctctactggggagacgccaagacagacaagatcgaggtgatcaatgttgatgggacgaagaggcggaccctcctggaggacaagctcccgcacattttygggttcacgctgctgggggacttcatctactggactgactggcagcgccgcagcatcgagcgggtgcacaaggtcaaggccagccgggacgtcatcattg

SEQ ID NO: 2018 - DNA, 201 bp, Homo sapiens
tgcaggaccgggcagccaagatcgaacgcgcagccctggacggcaccgagcgcgaggtcctcttcaccaccggcctcatccgccctgtggccctggtggtrgacaacacactgggcaagctgttctgggtggacgcggacctgaagcgcattgagagctgtgacctgtcaggggccaaccgcctgaccctggaggacgcca

SEQ ID NO: 2019 - DNA, 201 bp, Homo sapiens
tcatgaacgggagctcggtggagcacgtggtggagtttggccttgactaccccgagggcatggccgttgactggatgggcaagaacctctactgggccgayactgggaccaacagaatcgaagtggcgcggctggacgggcagttccggcaagtcctcgtgtggagggacttggacaacccgaggtcgctggccctggatc

SEQ ID NO: 2020 - DNA, 201 bp, Homo sapiens
cgaccgccagcagcagatgatcgagcgtgtggagaagaccaccggggacaagcggactcgcatccagggccgtgtcgcccacctcactggcatccatgcastggaggaagtcagcctggaggagttctcagcccacccatgtgcccgtgacaatggtggctgctcccacatctgtattgccaagggtgatgggacaccacg

SEQ ID NO: 2021 - DNA, 201 bp, Homo sapiens
tcagcgggaccccgcacgtgcccctcaatttcatagccccgggcggttcccagcatggccccttcacaggcatcgcatgcggaaagtccatgatgagctcygtgagcctgatggggggccggggcggggtgcccctctacgaccggaaccacgtcacaggggcctcgtccagcagctcgtccagcacgaaggccacgctgt

SEQ ID NO: 2022 - DNA, 201 bp, Homo sapiens
acgctgtacccgccgatcctgaacccgccgccctccccggccacggacccctccctgtacaacatggacatgttctactcttcaaacattccggccactgygagaccgtacaggccctacatcattcgaggaatggcgcccccgacgacgccctgcagcaccgacgtgtgtgacagcgactacagcgccagccgctggaag

SEQ ID NO: 2023 - DNA, 201 bp, Homo sapiens
cagccctggactttgatgtgtccaacaaccacatctactggacagacgtcagcctgaagaccatcagccgcgccttcatgaacgggagctcggtggagcaygtggtggagtttggccttgactaccccgagggcatggccgttgactggatgggcaagaacctctactgggccgacactgggaccaacagaatcgaagtgg

SEQ ID NO: 2024 - DNA, 177 bp, Homo sapiens
atggagcccgagtgagcgcggcgcgggcccgtccggccgccggacaacatggaggcagcgccgcccgggccgccgtrgccgctgctgctgctgctgctgctgctgctggcgctgtgcggctgcccggcccccgccgcggcctcgccgctcctgctatttgccaaccgccgggacgta

SEQ ID NO: 2025 - DNA, 201 bp, Homo sapiens
ctggaccgacctggacaccaacatgatcgagtcgtccaacatgctgggtcaggagcgggtcgtgattgccgacgatctcccgcacccgttcggtctgacgyagtacagcgattatatctactggacagactggaatctgcacagcattgagcgggccgacaagactagcggccggaaccgcaccctcatccagggccacct

SEQ ID NO: 2026 - DNA, 201 bp, Homo sapiens
agcatggccccttcacaggcatcgcatgcggaaagtccatgatgagctccgtgagcctgatggggggccggggcggggtgcccctctacgaccggaaccaygtcacaggggcctcgtccagcagctcgtccagcacgaaggccacgctgtacccgccgatcctgaacccgccgccctccccggccacggacccctccctgt

SEQ ID NO: 2027 - DNA, 201 bp, Homo sapiens
tgcaggacaacggcaggacgtgtaaggcaggagccgaggaggtgctgctgctggcccggcggacggacctacggaggatctcgctggacacgccggacttyaccgacatcgtgctgcaggtggacgacatccggcacgccattgccatcgactacgacccgctagagggctatgtctactggacagatgacgaggtgcggg

SEQ ID NO: 2028 - DNA, 201 bp, Homo sapiens
ggtgcagccacctgtgcttcttcacaccccacgcaacccggtgtggctgccccatcggcctggagctgctgagtgacatgaagacctgcatcgtgcctgargccttcttggtcttcaccagcagagccgccatccacaggatctccctcgagaccaataacaacgacgtggccatcccgctcacgggcgtcaaggaggcct

SEQ ID NO: 2029 - DNA, 201 bp, Homo sapiens
gtatccccggggcctggcgctgtgacggctttcccgagtgcgatgaccagagcgacgaggagggctgccccgtgtgctccgccgcccagttcccctgcgcrcggggtcagtgtgtggacctgcgcctgcgctgcgacggcgaggcagactgtcaggaccgctcagacgaggcggactgtgacgccatctgcctgcccaacc

SEQ ID NO: 2030 - DNA, 201 bp, Homo sapiens
gtgtgctccgccgcccagttcccctgcgcgcggggtcagtgtgtggacctgcgcctgcgctgcgacggcgaggcagactgtcaggaccgctcagacgaggyggactgtgacgccatctgcctgcccaaccagttccggtgtgcgagcggccagtgtgtcctcatcaaacagcagtgcgactccttccccgactgtatcgac

SEQ ID NO: 2031 - DNA, 201 bp, Homo sapiens
gaggcggaccctcctggaggacaagctcccgcacattttcgggttcacgctgctgggggacttcatctactggactgactggcagcgccgcagcatcgagygggtgcacaaggtcaaggccagccgggacgtcatcattgaccagctgcccgacctgatggggctcaaagctgtgaatgtggccaaggtcgtcggaaccaa

SEQ ID NO: 2032 - DNA, 201 bp, Homo sapiens
gagccgtgtactggacagacgtgagcgaggaggccatcaagcagacctacctgaaccagacgggggccgccgtgcagaacgtggtcatctccggcctggtstctcccgacggcctcgcctgcgactgggtgggcaagaagctgtactggacggactcagagaccaaccgcatcgaggtggccaacctcaatggcacatccc

SEQ ID NO: 2033 - DNA, 201 bp, Homo sapiens
gctgagtgacatgaagacctgcatcgtgcctgaggccttcttggtcttcaccagcagagccgccatccacaggatctccctcgagaccaataacaacgacrtggccatcccgctcacgggcgtcaaggaggcctcagccctggactttgatgtgtccaacaaccacatctactggacagacgtcagcctgaagaccatcag

SEQ ID NO: 2034 - DNA, 201 bp, Homo sapiens
gcgacaagcccagggccatcgtcgtcaacgcggagcgagggtacctgtacttcaccaacatgcaggaccgggcagccaagatcgaacgcgcagccctggayggcaccgagcgcgaggtcctcttcaccaccggcctcatccgccctgtggccctggtggtggacaacacactgggcaagctgttctgggtggacgcggacc

SEQ ID NO: 2035 - DNA, 201 bp, Homo sapiens
cggactgtgacgccatctgcctgcccaaccagttccggtgtgcgagcggccagtgtgtcctcatcaaacagcagtgcgactccttccccgactgtatcgayggctccgacgagctcatgtgtgaaatcaccaagccgccctcagacgacagcccggcccacagcagtgccatcgggcccgtcattggcatcatcctctctc

SEQ ID NO: 2036 - DNA, 201 bp, Homo sapiens
gcgggccatccgcagggcgtacctggacgggtctggggcgcagacgctggtcaacaccgagatcaacgaccccgatggcatcgcggtcgactgggtggccygaaacctctactggaccgacacgggcacggaccgcatcgaggtgacgcgcctcaacggcacctcccgcaagatcctggtgtcggaggacctggacgagcc

SEQ ID NO: 2037 - DNA, 201 bp, Homo sapiens
gcgccttcatgaacgggagctcggtggagcacgtggtggagtttggccttgactaccccgagggcatggccgttgactggatgggcaagaacctctactgrgccgacactgggaccaacagaatcgaagtggcgcggctggacgggcagttccggcaagtcctcgtgtggagggacttggacaacccgaggtcgctggccc

SEQ ID NO: 2038 - DNA, 201 bp, Homo sapiens
gcgcattgagagctgtgacctgtcaggggccaaccgcctgaccctggaggacgccaacatcgtgcagcctctgggcctgaccatccttggcaagcatctcyactggatcgaccgccagcagcagatgatcgagcgtgtggagaagaccaccggggacaagcggactcgcatccagggccgtgtcgcccacctcactggcat

SEQ ID NO: 2039 - DNA, 201 bp, Homo sapiens
gtactggacagacgtgagcgaggaggccatcaagcagacctacctgaaccagacgggggccgccgtgcagaacgtggtcatctccggcctggtctctccckacggcctcgcctgcgactgggtgggcaagaagctgtactggacggactcagagaccaaccgcatcgaggtggccaacctcaatggcacatcccggaaggt

SEQ ID NO: 2040 - DNA, 201 bp, Homo sapiens
gatggatggcagcacccggaagatcattgtggactcggacatttactggcccaatggactgaccatcgacctggaggagcagaagctctactgggctgacrccaagctcagcttcatccaccgtgccaacctggacggctcgttccggcagaaggtggtggagggcagcctgacgcaccccttcgccctgacgctctccgg

SEQ ID NO: 2041 - DNA, 201 bp, Homo sapiens
atggatggcagcacccggaagatcattgtggactcggacatttactggcccaatggactgaccatcgacctggaggagcagaagctctactgggctgacgycaagctcagcttcatccaccgtgccaacctggacggctcgttccggcagaaggtggtggagggcagcctgacgcaccccttcgccctgacgctctccggg

SEQ ID NO: 2042 - DNA, 201 bp, Homo sapiens
caccgtgccaacctggacggctcgttccggcagaaggtggtggagggcagcctgacgcaccccttcgccctgacgctctccggggacactctgtactggayagactggcagacccgctccatccatgcctgcaacaagcgcactggggggaagaggaaggagatcctgagtgccctctactcacccatggacatccaggtg

SEQ ID NO: 2043 - DNA, 201 bp, Homo sapiens; identical to SEQ ID NO: 2013

SEQ ID NO: 2044 - DNA, 201 bp, Homo sapiens; identical to SEQ ID NO: 2014

SEQ ID NO: 2045 - DNA, 201 bp, Homo sapiens; identical to SEQ ID NO: 2015

SEQ ID NO: 2046 - DNA, 201 bp, Homo sapiens; identical to SEQ ID NO: 2016

SEQ ID NO: 2047 - DNA, 201 bp, Homo sapiens; identical to SEQ ID NO: 2017

SEQ ID NO: 2048 - DNA, 201 bp, Homo sapiens; identical to SEQ ID NO: 2018

SEQ ID NO: 2049 - DNA, 201 bp, Homo sapiens; identical to SEQ ID NO: 2019

SEQ ID NO: 2050 - DNA, 201 bp, Homo sapiens; identical to SEQ ID NO: 2020

SEQ ID NO: 2051 - DNA, 201 bp, Homo sapiens; identical to SEQ ID NO: 2021

SEQ ID NO: 2052 - DNA, 201 bp, Homo sapiens; identical to SEQ ID NO: 2022

SEQ ID NO: 2053 - DNA, 201 bp, Homo sapiens; identical to SEQ ID NO: 2023

SEQ ID NO: 2054 - DNA, 177 bp, Homo sapiens; identical to SEQ ID NO: 2024

SEQ ID NO: 2055 - DNA, 201 bp, Homo sapiens; identical to SEQ ID NO: 2025

SEQ ID NO: 2056 - DNA, 201 bp, Homo sapiens; identical to SEQ ID NO: 2026

SEQ ID NO: 2057 - DNA, 201 bp, Homo sapiens; identical to SEQ ID NO: 2027

SEQ ID NO: 2058 - DNA, 201 bp, Homo sapiens; identical to SEQ ID NO: 2028

SEQ ID NO: 2059 - DNA, 201 bp, Homo sapiens; identical to SEQ ID NO: 2029

SEQ ID NO: 2060 - DNA, 201 bp, Homo sapiens; identical to SEQ ID NO: 2030

SEQ ID NO: 2061 - DNA, 201 bp, Homo sapiens; identical to SEQ ID NO: 2031

SEQ ID NO: 2062 - DNA, 201 bp, Homo sapiens; identical to SEQ ID NO: 2032

SEQ ID NO: 2063 - DNA, 201 bp, Homo sapiens; identical to SEQ ID NO: 2033

SEQ ID NO: 2064 - DNA, 201 bp, Homo sapiens; identical to SEQ ID NO: 2034

SEQ ID NO: 2065 - DNA, 201 bp, Homo sapiens; identical to SEQ ID NO: 2035

SEQ ID NO: 2066 - DNA, 201 bp, Homo sapiens; identical to SEQ ID NO: 2036

SEQ ID NO: 2067 - DNA, 201 bp, Homo sapiens; identical to SEQ ID NO: 2037

SEQ ID NO: 2068 - DNA, 201 bp, Homo sapiens; identical to SEQ ID NO: 2038

SEQ ID NO: 2069 - DNA, 201 bp, Homo sapiens; identical to SEQ ID NO: 2039

SEQ ID NO: 2070 - DNA, 201 bp, Homo sapiens; identical to SEQ ID NO: 2040

SEQ ID NO: 2071 - DNA, 201 bp, Homo sapiens; identical to SEQ ID NO: 2041

SEQ ID NO: 2072 - DNA, 201 bp, Homo sapiens; identical to SEQ ID NO: 2042

SEQ ID NO: 2073 - DNA, 201 bp, Homo sapiens
tttagcccagaactgctttgaatacaccaattgctgtggggcggctcgaggaagagaagacaccagtgcctcagaaactgctcggtcagacggtgatagcragccacgcattcacagggccactgctgctcacagaagcagtgaggatgatgccaggatgatgtctgcctcgcgcctggctgggactctgatcccagccat

SEQ ID NO: 2074 - DNA, 201 bp, Homo sapiens
ggggcggctcgaggaagagaagacaccagtgcctcagaaactgctcggtcagacggtgatagcgagccacgcattcacagggccactgctgctcacagaascagtgaggatgatgccaggatgatgtctgcctcgcgcctggctgggactctgatcccagccatggccttcctctcctgcgtgagaccagaaagctgggag

SEQ ID NO: 2075 - DNA, 201 bp, Homo sapiens
atagcttcttcagtttcccagaactgcaggtgctggatttatccaggtgtgaaatccagacaattgaagatggggcatatcagagcctaagccacctctcyaccttaatattgacaggaaaccccatccagagtttagccctgggagccttttctggactatcaagtttacagaagctggtggctgtggagacaaatctag

SEQ ID NO: 2076 - DNA, 201 bp, Homo sapiens
acaaatctgctctagagggcctgtgcaatttgaccattgaagaattccgattagcatacttagactactacctcgatgatattattgacttatttaattgkttgacaaatgtttcttcattttccctggtgagtgtgactattgaaagggtaaaagacttttcttataatttcggatggcaacatttagaattagttaact

SEQ ID NO: 2077 - DNA, 201 bp, Homo sapiens
ttataatttcggatggcaacatttagaattagttaactgtaaatttggacagtttcccacattgaaactcaaatctctcaaaaggcttactttcacttccracaaaggtgggaatgctttttcagaagttgatctaccaagccttgagtttctagatctcagtagaaatggcttgagtttcaaaggttgctgttctcaaag

SEQ ID NO: 2078 - DNA, 201 bp, Homo sapiens
ttcagtattcctatcactcagaaacctcatttaccttgacatttctcatactcacaccagagttgctttcaatggcatcttcaatggcttgtccagtctcraagtcttgaaaatggctggcaattctttccaggaaaacttccttccagatatcttcacagagctgagaaacttgaccttcctggacctctctcagtgtca

SEQ ID NO: 2079 - DNA, 201 bp, Homo sapiens
ctctcaaaaggcttactttcacttccaacaaaggtgggaatgctttttcagaagttgatctaccaagccttgagtttctagatctcagtagaaatggcttkagtttcaaaggttgctgttctcaaagtgattttgggacaaccagcctaaagtatttagatctgagcttcaatggtgttattaccatgagttcaaacttct

SEQ ID NO: 2080 - DNA, 201 bp, Homo sapiens
gtgttattaccatgagttcaaacttcttgggcttagaacaactagaacatctggatttccagcattccaatttgaaacaaatgagtgagttttcagtattyctatcactcagaaacctcatttaccttgacatttctcatactcacaccagagttgctttcaatggcatcttcaatggcttgtccagtctcgaagtcttga

SEQ ID NO: 2081 - DNA, 201 bp, Homo sapiens
tgctgagtttgaatatcacctgtcagatgaataagaccatcattggtgtgtcggtcctcagtgtgcttgtagtatctgttgtagcagttctggtctataarttctattttcacctgatgcttcttgctggctgcataaagtatggtagaggtgaaaacatctatgatgcctttgttatctactcaagccaggatgaggact

SEQ ID NO: 2082 - DNA, 201 bp, Homo sapiens
gctttttcagaagttgatctaccaagccttgagtttctagatctcagtagaaatggcttgagtttcaaaggttgctgttctcaaagtgattttgggacaaycagcctaaagtatttagatctgagcttcaatggtgttattaccatgagttcaaacttcttgggcttagaacaactagaacatctggatttccagcattcc

SEQ ID NO: 2083 - DNA, 201 bp, Homo sapiens
ccttcctggacctctctcagtgtcaactggagcagttgtctccaacagcatttaactcactctccagtcttcaggtactaaatatgagccacaacaacttmttttcattggatacgtttccttataagtgtctgaactccctccaggttcttgattacagtctcaatcacataatgacttccaaaaaacaggaactacagc

SEQ ID NO: 2084 - DNA, 201 bp, Homo sapiens
aaagggtaaaagacttttcttataatttcggatggcaacatttagaattagttaactgtaaatttggacagtttcccacattgaaactcaaatctctcaaraggcttactttcacttccaacaaaggtgggaatgctttttcagaagttgatctaccaagccttgagtttctagatctcagtagaaatggcttgagtttca

SEQ ID NO: 2085 - DNA, 201 bp, Homo sapiens
ttcctctcaccctttagcccagaactgctttgaatacaccaattgctgtggggcggctcgaggaagagaagacaccagtgcctcagaaactgctcggtcaracggtgatagcgagccacgcattcacagggccactgctgctcacagaagcagtgaggatgatgccaggatgatgtctgcctcgcgcctggctgggactct

SEQ ID NO: 2086 - DNA, 201 bp, Homo sapiens
tagcccagaactgctttgaatacaccaattgctgtggggcggctcgaggaagagaagacaccagtgcctcagaaactgctcggtcagacggtgatagcgarccacgcattcacagggccactgctgctcacagaagcagtgaggatgatgccaggatgatgtctgcctcgcgcctggctgggactctgatcccagccatgg

SEQ ID NO: 2087 - DNA, 201 bp, Homo sapiens
tgtggggcggctcgaggaagagaagacaccagtgcctcagaaactgctcggtcagacggtgatagcgagccacgcattcacagggccactgctgctcacaraagcagtgaggatgatgccaggatgatgtctgcctcgcgcctggctgggactctgatcccagccatggccttcctctcctgcgtgagaccagaaagctgg

SEQ ID NO: 2088 - DNA, 201 bp, Homo sapiens
gaaggaaacttggaaaagtttgacaaatctgctctagagggcctgtgcaatttgaccattgaagaattccgattagcatacttagactactacctcgatgrtattattgacttatttaattgtttgacaaatgtttcttcattttccctggtgagtgtgactattgaaagggtaaaagacttttcttataatttcggatgg

SEQ ID NO: 2089 - DNA, 201 bp, Homo sapiens
ctagagggcctgtgcaatttgaccattgaagaattccgattagcatacttagactactacctcgatgatattattgacttatttaattgtttgacaaatgkttcttcattttccctggtgagtgtgactattgaaagggtaaaagacttttcttataatttcggatggcaacatttagaattagttaactgtaaatttgga

SEQ ID NO: 2090 - DNA, 201 bp, Homo sapiens
accccatccagagtttagccctgggagccttttctggactatcaagtttacagaagctggtggctgtggagacaaatctagcatctctagagaacttcccmattggacatctcaaaactttgaaagaacttaatgtggctcacaatcttatccaatctttcaaattacctgagtatttttctaatctgaccaatctagagc

SEQ ID NO: 2091 - DNA, 201 bp, Homo sapiens
aaatggctggcaattctttccaggaaaacttccttccagatatcttcacagagctgagaaacttgaccttcctggacctctctcagtgtcaactggagcakttgtctccaacagcatttaactcactctccagtcttcaggtactaaatatgagccacaacaacttcttttcattggatacgtttccttataagtgtctga

SEQ ID NO: 2092 - DNA, 201 bp, Homo sapiens
agctggtggctgtggagacaaatctagcatctctagagaacttccccattggacatctcaaaactttgaaagaacttaatgtggctcacaatcttatccartctttcaaattacctgagtatttttctaatctgaccaatctagagcacttggacctttccagcaacaagattcaaagtatttattgcacagacttgcggg

SEQ ID NO: 2093 - DNA, 201 bp, Homo sapiens
cttaatgtggctcacaatcttatccaatctttcaaattacctgagtatttttctaatctgaccaatctagagcacttggacctttccagcaacaagattcraagtatttattgcacagacttgcgggttctacatcaaatgcccctactcaatctctctttagacctgtccctgaaccctatgaactttatccaaccaggt

SEQ ID NO: 2094 - DNA, 201 bp, Homo sapiens
aaccctatgaactttatccaaccaggtgcatttaaagaaattaggcttcataagctgactttaagaaataattttgatagtttaaatgtaatgaaaacttstattcaaggtctggctggtttagaagtccatcgtttggttctgggagaatttagaaatgaaggaaacttggaaaagtttgacaaatctgctctagagggc

SEQ ID NO: 2095 - DNA, 201 bp, Homo sapiens
tacctcgatgatattattgacttatttaattgtttgacaaatgtttcttcattttccctggtgagtgtgactattgaaagggtaaaagacttttcttatartttcggatggcaacatttagaattagttaactgtaaatttggacagtttcccacattgaaactcaaatctctcaaaaggcttactttcacttccaacaaa

SEQ ID NO: 2096 - DNA, 201 bp, Homo sapiens
aaaaacaggaactacagcattttccaagtagtctagctttcttaaatcttactcagaatgactttgcttgtacttgtgaacaccagagtttcctgcaatgratcaaggaccagaggcagctcttggtggaagttgaacgaatggaatgtgcaacaccttcagataagcagggcatgcctgtgctgagtttgaatatcacct

SEQ ID NO: 2097 - DNA, 201 bp, Homo sapiens
cttgctggctgcataaagtatggtagaggtgaaaacatctatgatgcctttgttatctactcaagccaggatgaggactgggtaaggaatgagctagtaargaatttagaagaaggggtgcctccatttcagctctgccttcactacagagactttattcccggtgtggccattgctgccaacatcatccatgaaggtttc

SEQ ID NO: 2098 - DNA, 201 bp, Homo sapiens
agccgaaaggtgattgttgtggtgtcccagcacttcatccagagccgctggtgtatctttgaatatgagattgctcagacctggcagtttctgagcagtcrtgctggtatcatcttcattgtcctgcagaaggtggagaagaccctgctcaggcagcaggtggagctgtaccgccttctcagcaggaacacttacctggag

SEQ ID NO: 2099 - DNA, 201 bp, Homo sapiens
tgtcctggggcggcacatcttctggagacgactcagaaaagccctgctggatggtaaatcatggaatccagaaggaacagtgggtacaggatgcaattggmaggaagcaacatctatctgaagaggaaaaataaaaacctcctgaggcatttcttgcccagctgggtccaacacttgttcagttaataagtattaaatgct

SEQ ID NO: 2100 - DNA, 201 bp, Homo sapiens
gttcagttaataagtattaaatgctgccacatgtcaggccttatgctaagggtgagtaattccatggtgcactagatatgcagggctgctaatctcaaggmgcttccagtgcagagggaataaatgctagactaaaatacagagtcttccaggtgggcatttcaaccaactcagtcaaggaacccatgacaaagaaagtca

SEQ ID NO: 2101 - DNA, 201 bp, Homo sapiens
aagagacattgttcttttcctgagtcttttgaatggaaattgtattatgttatagccatcataaaaccattttggtagttttgactgaactgggtgttcaytttttcctttttgattgaatacaatttaaattctacttgatgactgcagtcgtcaaggggctcctgatgcaagatgccccttccattttaagtctgtctc

SEQ ID NO: 2102 - DNA, 201 bp, Homo sapiens
acaatttaaattctacttgatgactgcagtcgtcaaggggctcctgatgcaagatgccccttccattttaagtctgtctccttacagaggttaaagtctartggctaattcctaaggaaacctgattaacacatgctcacaaccatcctggtcattctcgagcatgttctattttttaactaatcacccctgatatatttt

SEQ ID NO: 2103 - DNA, 201 bp, Homo sapiens
tccattttaagtctgtctccttacagaggttaaagtctagtggctaattcctaaggaaacctgattaacacatgctcacaaccatcctggtcattctcgarcatgttctattttttaactaatcacccctgatatatttttatttttatatatccagttttcatttttttacgtcttgcctataagctaatatcataaata

SEQ ID NO: 2104 - DNA, 201 bp, Homo sapiens
tttttttacgtcttgcctataagctaatatcataaataaggttgtttaagacgtgcttcaaatatccatattaaccactatttttcaaggaagtatggaaragtacactctgtcactttgtcactcgatgtcattccaaagttattgcctactaagtaatgactgtcatgaaagcagcattgaaataatttgtttaaaggg

SEQ ID NO: 2105 - DNA, 201 bp, Homo sapiens
ctttgtcactcgatgtcattccaaagttattgcctactaagtaatgactgtcatgaaagcagcattgaaataatttgtttaaagggggcactcttttaaaygggaagaaaatttccgcttcctggtcttatcatggacaatttgggctagaggcaggaaggaagtgggatgacctcaggaggtcaccttttcttgattcca

SEQ ID NO: 2106 - DNA, 201 bp, Homo sapiens
gtcatgaaagcagcattgaaataatttgtttaaagggggcactcttttaaacgggaagaaaatttccgcttcctggtcttatcatggacaatttgggctakaggcaggaaggaagtgggatgacctcaggaggtcaccttttcttgattccagaaacatatgggctgataaacccggggtgacctcatgaaatgagttgca

SEQ ID NO: 2107 - DNA, 201 bp, Homo sapiens
aaagcagcattgaaataatttgtttaaagggggcactcttttaaacgggaagaaaatttccgcttcctggtcttatcatggacaatttgggctagaggcakgaaggaagtgggatgacctcaggaggtcaccttttcttgattccagaaacatatgggctgataaacccggggtgacctcatgaaatgagttgcagcagaa

SEQ ID NO: 2108 - DNA, 201 bp, Homo sapiens
taatttgtttaaagggggcactcttttaaacgggaagaaaatttccgcttcctggtcttatcatggacaatttgggctagaggcaggaaggaagtgggatkacctcaggaggtcaccttttcttgattccagaaacatatgggctgataaacccggggtgacctcatgaaatgagttgcagcagaagtttatttttttcag

SEQ ID NO: 2109 - DNA, 201 bp, Homo sapiens
aaagggggcactcttttaaacgggaagaaaatttccgcttcctggtcttatcatggacaatttgggctagaggcaggaaggaagtgggatgacctcaggargtcaccttttcttgattccagaaacatatgggctgataaacccggggtgacctcatgaaatgagttgcagcagaagtttatttttttcagaacaagtgat

SEQ ID NO: 2110 - DNA, 201 bp, Homo sapiens
ggaaggaagtgggatgacctcaggaggtcaccttttcttgattccagaaacatatgggctgataaacccggggtgacctcatgaaatgagttgcagcagawgtttatttttttcagaacaagtgatgtttgatggacctctgaatctctttagggagacacagatggctgggatccctcccctgtacccttctcactgcca

SEQ ID NO: 2111 - DNA, 201 bp, Homo sapiens
gattccagaaacatatgggctgataaacccggggtgacctcatgaaatgagttgcagcagaagtttatttttttcagaacaagtgatgtttgatggacctmtgaatctctttagggagacacagatggctgggatccctcccctgtacccttctcactgccaggagaactacgtgtgaaggtattcaaggcagggagtata

SEQ ID NO: 2112 - DNA, 201 bp, Homo sapiens
aaacatatgggctgataaacccggggtgacctcatgaaatgagttgcagcagaagtttatttttttcagaacaagtgatgtttgatggacctctgaatctmtttagggagacacagatggctgggatccctcccctgtacccttctcactgccaggagaactacgtgtgaaggtattcaaggcagggagtatacattgctg

SEQ ID NO: 2113 - DNA, 201 bp, Homo sapiens
agttgcagcagaagtttatttttttcagaacaagtgatgtttgatggacctctgaatctctttagggagacacagatggctgggatccctcccctgtaccyttctcactgccaggagaactacgtgtgaaggtattcaaggcagggagtatacattgctgtttcctgttgggcaatgctccttgaccacattttgggaaga

SEQ ID NO: 2114 - DNA, 201 bp, Homo sapiens
gaagtttatttttttcagaacaagtgatgtttgatggacctctgaatctctttagggagacacagatggctgggatccctcccctgtacccttctcactgmcaggagaactacgtgtgaaggtattcaaggcagggagtatacattgctgtttcctgttgggcaatgctccttgaccacattttgggaagagtggatgtta

SEQ ID NO: 2115 - DNA, 201 bp, Homo sapiens
ccttctcactgccaggagaactacgtgtgaaggtattcaaggcagggagtatacattgctgtttcctgttgggcaatgctccttgaccacattttgggaasagtggatgttatcattgagaaaacaatgtgtctggaattaatggggttcttataaagaaggttcccagaaaagaatgttcatccagcctcctcagaaaca

SEQ ID NO: 2116 - DNA, 201 bp, Homo sapiens
aaatcagaatttcaagaaaatatttacactcccatgttcattgtggcactcttcacaatcactgtttccaaagttatggaaacaacccaaatttccattgraaaataaatggacaaagaaaatgtgcatatacgtacaatgggatattattcagcctaaaaaaagggggaatcctgttatttatgacaacatgaataaacc

SEQ ID NO: 2117 - DNA, 201 bp, Homo sapiens
aatatttacactcccatgttcattgtggcactcttcacaatcactgtttccaaagttatggaaacaacccaaatttccattgaaaaataaatggacaaagraaatgtgcatatacgtacaatgggatattattcagcctaaaaaaagggggaatcctgttatttatgacaacatgaataaacccggaggccattatgctat

SEQ ID NO: 2118 - DNA, 201 bp, Homo sapiens
aaagttatggaaacaacccaaatttccattgaaaaataaatggacaaagaaaatgtgcatatacgtacaatgggatattattcagcctaaaaaaagggggratcctgttatttatgacaacatgaataaacccggaggccattatgctatgtaaaatgagcaagtaacagaaagacaaatactgcctgatttcatttatat

SEQ ID NO: 2119 - DNA, 201 bp, Homo sapiens
gaggaagggagaaatgaggaaatagggagttgtctaattggtataaaattatagtatgcaagatgaattagctctaaagatcagctgtatagcagagttcstataatgaacaatactgtattatgcacttaacattttgttaagagggtacctctcatgttaagtgttcttaccatatacatatacacaaggaagcttttg

SEQ ID NO: 2120 - DNA, 201 bp, Homo sapiens
tactgagtgtttcagagtgtgtttggtttgagcaggtctagggtgattgaacatccctgggtgtgtttccatgtctcatgtactagtgaaagtagatgtgygcatttgtgcacatatccctatgtatccctatcagggctgtgtgtatttgaaagtgtgtgtgtccgcatgatcatatctgtatagaagagagtgtgatta

SEQ ID NO: 2121 - DNA, 201 bp, Homo sapiens
tatttgaaagtgtgtgtgtccgcatgatcatatctgtatagaagagagtgtgattatatttcttgaagaatacatccatttgaaatggatgtctatggctrtttgagatgagttctctactcttgtgcttgtacagtagtctccccttatcccttatgcttggtggatacgttcttagaccccaagtggatctctgagacc

SEQ ID NO: 2122 - DNA, 201 bp, Homo sapiens
tacatccatttgaaatggatgtctatggctgtttgagatgagttctctactcttgtgcttgtacagtagtctccccttatcccttatgcttggtggatacrttcttagaccccaagtggatctctgagaccgcagatggtaccaaacctcatatatgcaatattttttcctatacataaatacctaagataaagttcatct

SEQ ID NO: 2123 - DNA, 154 bp, Homo sapiens
ccttatcccttatgcttggtggatacgttcttagaccccaagtggatctctgagaccgcagatggtaccaaacctcatatatgcaatattttttcctatayataaatacctaagataaagttcatcttctgaattaggcacagtaagagattaa

SEQ ID NO: 2124 - DNA, 201 bp, Homo sapiens; identical to SEQ ID NO: 2073

SEQ ID NO: 2125 - DNA, 201 bp, Homo sapiens; identical to SEQ ID NO: 2074

SEQ ID NO: 2126 - DNA, 201 bp, Homo sapiens; identical to SEQ ID NO: 2075

SEQ ID NO: 2127 - DNA, 201 bp, Homo sapiens; identical to SEQ ID NO: 2076

SEQ ID NO: 2128 - DNA, 201 bp, Homo sapiens; identical to SEQ ID NO: 2077

SEQ ID NO: 2129 - DNA, 201 bp, Homo sapiens
gcgcctggctgggactctgatcccagccatggccttcctctcctgcgtgagaccagaaagctgggagccctgcgtggagacttggccctaaaccacacagmagagctggcatgaaacccagagctttcagactccggagcctcagcccttcaccccgattccattgcttcttgctaaatgctgccgttttatcacggaggt

SEQ ID NO: 2130 - DNA, 201 bp, Homo sapiens; identical to SEQ ID NO: 2078

SEQ ID NO: 2131 - DNA, 201 bp, Homo sapiens; identical to SEQ ID NO: 2079

SEQ ID NO: 2132 - DNA, 201 bp, Homo sapiens; identical to SEQ ID NO: 2080

SEQ ID NO: 2133 - DNA, 201 bp, Homo sapiens; identical to SEQ ID NO: 2081

SEQ ID NO: 2134 - DNA, 201 bp, Homo sapiens; identical to SEQ ID NO: 2082

SEQ ID NO: 2135 - DNA, 201 bp, Homo sapiens; identical to SEQ ID NO: 2083

SEQ ID NO: 2136 - DNA, 201 bp, Homo sapiens; identical to SEQ ID NO: 2084

SEQ ID NO: 2137 - DNA, 201 bp, Homo sapiens; identical to SEQ ID NO: 2085

SEQ ID NO: 2138 - DNA, 201 bp, Homo sapiens; identical to SEQ ID NO: 2086

SEQ ID NO: 2139 - DNA, 201 bp, Homo sapiens; identical to SEQ ID NO: 2087

SEQ ID NO: 2140 - DNA, 201 bp, Homo sapiens; identical to SEQ ID NO: 2088

SEQ ID NO: 2141 - DNA, 201 bp, Homo sapiens; identical to SEQ ID NO: 2089

SEQ ID NO: 2142 - DNA, 201 bp, Homo sapiens; identical to SEQ ID NO: 2090

SEQ ID NO: 2143 - DNA, 201 bp, Homo sapiens; identical to SEQ ID NO: 2091

SEQ ID NO: 2144 - DNA, 201 bp, Homo sapiens; identical to SEQ ID NO: 2092

SEQ ID NO: 2145 - DNA, 201 bp, Homo sapiens; identical to SEQ ID NO: 2093

SEQ ID NO: 2146 - DNA, 201 bp, Homo sapiens; identical to SEQ ID NO: 2094

SEQ ID NO: 2147 - DNA, 201 bp, Homo sapiens; identical to SEQ ID NO: 2095

SEQ ID NO: 2148 - DNA, 201 bp, Homo sapiens; identical to SEQ ID NO: 2096

SEQ ID NO: 2149 - DNA, 201 bp, Homo sapiens; identical to SEQ ID NO: 2097

SEQ ID NO: 2150 - DNA, 201 bp, Homo sapiens; identical to SEQ ID NO: 2098

SEQ ID NO: 2151 - DNA, 201 bp, Homo sapiens; identical to SEQ ID NO: 2099

SEQ ID NO: 2152 - DNA, 201 bp, Homo sapiens; identical to SEQ ID NO: 2100

SEQ ID NO: 2153 - DNA, 201 bp, Homo sapiens; identical to SEQ ID NO: 2101

SEQ ID NO: 2154 - DNA, 201 bp, Homo sapiens; identical to SEQ ID NO: 2102

SEQ ID NO: 2155 - DNA, 201 bp, Homo sapiens; identical to SEQ ID NO: 2103

SEQ ID NO: 2156 - DNA, 201 bp, Homo sapiens; identical to SEQ ID NO: 2104

SEQ ID NO: 2157 - DNA, 201 bp, Homo sapiens; identical to SEQ ID NO: 2105

SEQ ID NO: 2158 - DNA, 201 bp, Homo sapiens; identical to SEQ ID NO: 2106

SEQ ID NO: 2159 - DNA, 201 bp, Homo sapiens; identical to SEQ ID NO: 2107

SEQ ID NO: 2160 - DNA, 201 bp, Homo sapiens; identical to SEQ ID NO: 2108

SEQ ID NO: 2161 - DNA, 201 bp, Homo sapiens; identical to SEQ ID NO: 2109

SEQ ID NO: 2162 - DNA, 201 bp, Homo sapiens; identical to SEQ ID NO: 2110

SEQ ID NO: 2163 - DNA, 201 bp, Homo sapiens; identical to SEQ ID NO: 2111

SEQ ID NO: 2164 - DNA, 201 bp, Homo sapiens; identical to SEQ ID NO: 2112

SEQ ID NO: 2165 - DNA, 201 bp, Homo sapiens; identical to SEQ ID NO: 2113

SEQ ID NO: 2166 - DNA, 201 bp, Homo sapiens; identical to SEQ ID NO: 2114

SEQ ID NO: 2167 - DNA, 201 bp, Homo sapiens; identical to SEQ ID NO: 2115

SEQ ID NO: 2168 - DNA, 201 bp, Homo sapiens; identical to SEQ ID NO: 2116

SEQ ID NO: 2169 - DNA, 201 bp, Homo sapiens; identical to SEQ ID NO: 2117

SEQ ID NO: 2170 - DNA, 201 bp, Homo sapiens; identical to SEQ ID NO: 2118

SEQ ID NO: 2171 - DNA, 201 bp, Homo sapiens; identical to SEQ ID NO: 2119

SEQ ID NO: 2172 - DNA, 201 bp, Homo sapiens; identical to SEQ ID NO: 2120

SEQ ID NO: 2173 - DNA, 201 bp, Homo sapiens; identical to SEQ ID NO: 2121

SEQ ID NO: 2174 - DNA, 201 bp, Homo sapiens; identical to SEQ ID NO: 2122

SEQ ID NO: 2175 - DNA, 154 bp, Homo sapiens; identical to SEQ ID NO: 2123

SEQ ID NO: 2176 - DNA, 201 bp, Homo sapiens; identical to SEQ ID NO: 2073

SEQ ID NO: 2177 - DNA, 201 bp, Homo sapiens; identical to SEQ ID NO: 2074

SEQ ID NO: 2178 - DNA, 201 bp, Homo sapiens
cttcctctcctgcgtgagaccagaaagctgggagccctgcgtggaggtgtgaaatccagacaattgaagatggggcatatcagagcctaagccacctctcyaccttaatattgacaggaaaccccatccagagtttagccctgggagccttttctggactatcaagtttacagaagctggtggctgtggagacaaatctag

SEQ ID NO: 2179 - DNA, 201 bp, Homo sapiens; identical to SEQ ID NO: 2076

SEQ ID NO: 2180 - DNA, 201 bp, Homo sapiens; identical to SEQ ID NO: 2077

SEQ ID NO: 2181 - DNA, 201 bp, Homo sapiens; identical to SEQ ID NO: 2078

SEQ ID NO: 2182 - DNA, 201 bp, Homo sapiens; identical to SEQ ID NO: 2079

SEQ ID NO: 2183 - DNA, 201 bp, Homo sapiens; identical to SEQ ID NO: 2080

SEQ ID NO: 2184 - DNA, 201 bp, Homo sapiens; identical to SEQ ID NO: 2081

SEQ ID NO: 2185 - DNA, 201 bp, Homo sapiens; identical to SEQ ID NO: 2082

SEQ ID NO: 2186 - DNA, 201 bp, Homo sapiens; identical to SEQ ID NO: 2083

SEQ ID NO: 2187 - DNA, 201 bp, Homo sapiens; identical to SEQ ID NO: 2084

SEQ ID NO: 2188 - DNA, 201 bp, Homo sapiens; identical to SEQ ID NO: 2085

SEQ ID NO: 2189 - DNA, 201 bp, Homo sapiens; identical to SEQ ID NO: 2086

SEQ ID NO: 2190 - DNA, 201 bp, Homo sapiens; identical to SEQ ID NO: 2087

SEQ ID NO: 2191 - DNA, 201 bp, Homo sapiens; identical to SEQ ID NO: 2088

SEQ ID NO: 2192 - DNA, 201 bp, Homo sapiens; identical to SEQ ID NO: 2089

SEQ ID NO: 2193 - DNA, 201 bp, Homo sapiens; identical to SEQ ID NO: 2090

SEQ ID NO: 2194 - DNA, 201 bp, Homo sapiens; identical to SEQ ID NO: 2091

SEQ ID NO: 2195 - DNA, 201 bp, Homo sapiens; identical to SEQ ID NO: 2094

SEQ ID NO: 2196 - DNA, 201 bp, Homo sapiens; identical to SEQ ID NO: 2095

SEQ ID NO: 2197 - DNA, 201 bp, Homo sapiens; identical to SEQ ID NO: 2096

SEQ ID NO: 2198 - DNA, 201 bp, Homo sapiens; identical to SEQ ID NO: 2097

SEQ ID NO: 2199 - DNA, 201 bp, Homo sapiens; identical to SEQ ID NO: 2098

SEQ ID NO: 2200 - DNA, 201 bp, Homo sapiens; identical to SEQ ID NO: 2099

SEQ ID NO: 2201 - DNA, 201 bp, Homo sapiens; identical to SEQ ID NO: 2100

SEQ ID NO: 2202 - DNA, 201 bp, Homo sapiens; identical to SEQ ID NO: 2101

SEQ ID NO: 2203 - DNA, 201 bp, Homo sapiens; identical to SEQ ID NO: 2102

SEQ ID NO: 2204 - DNA, 201 bp, Homo sapiens; identical to SEQ ID NO: 2103

SEQ ID NO: 2205 - DNA, 201 bp, Homo sapiens; identical to SEQ ID NO: 2104

SEQ ID NO: 2206 - DNA, 201 bp, Homo sapiens; identical to SEQ ID NO: 2105

SEQ ID NO: 2207 - DNA, 201 bp, Homo sapiens; identical to SEQ ID NO: 2106

SEQ ID NO: 2208 - DNA, 201 bp, Homo sapiens; identical to SEQ ID NO: 2107

SEQ ID NO: 2209 - DNA, 201 bp, Homo sapiens; identical to SEQ ID NO: 2108

SEQ ID NO: 2210 - DNA, 201 bp, Homo sapiens; identical to SEQ ID NO: 2109

SEQ ID NO: 2211 - DNA, 201 bp, Homo sapiens; identical to SEQ ID NO: 2110

SEQ ID NO: 2212 - DNA, 201 bp, Homo sapiens; identical to SEQ ID NO: 2111

SEQ ID NO: 2213 - DNA, 201 bp, Homo sapiens; identical to SEQ ID NO: 2112

SEQ ID NO: 2214 - DNA, 201 bp, Homo sapiens; identical to SEQ ID NO: 2113

SEQ ID NO: 2215 - DNA, 201 bp, Homo sapiens; identical to SEQ ID NO: 2114

SEQ ID NO: 2216 - DNA, 201 bp, Homo sapiens; identical to SEQ ID NO: 2115

SEQ ID NO: 2217 - DNA, 201 bp, Homo sapiens; identical to SEQ ID NO: 2116

SEQ ID NO: 2218 - DNA, 201 bp, Homo sapiens; identical to SEQ ID NO: 2117

SEQ ID NO: 2219 - DNA, 201 bp, Homo sapiens; identical to SEQ ID NO: 2118

SEQ ID NO: 2220 - DNA, 201 bp, Homo sapiens; identical to SEQ ID NO: 2119

SEQ ID NO: 2221 - DNA, 201 bp, Homo sapiens; identical to SEQ ID NO: 2120

SEQ ID NO: 2222 - DNA, 201 bp, Homo sapiens; identical to SEQ ID NO: 2121

SEQ ID NO: 2223 - DNA, 201 bp, Homo sapiens; identical to SEQ ID NO: 2122

SEQ ID NO: 2224 - DNA, 154 bp, Homo sapiens; identical to SEQ ID NO: 2123

SEQ ID NO: 2225 - DNA, 201 bp, Homo sapiens; identical to SEQ ID NO: 2092

SEQ ID NO: 2226 - DNA, 201 bp, Homo sapiens; identical to SEQ ID NO: 2093

SEQ ID NO: 2227 - DNA, 201 bp, Homo sapiens; identical to SEQ ID NO: 2073

SEQ ID NO: 2228 - DNA, 201 bp, Homo sapiens; identical to SEQ ID NO: 2074

SEQ ID NO: 2229 - DNA, 201 bp, Homo sapiens
cccgattccattgcttcttgctaaatgctgccgttttatcacggaggtgtgaaatccagacaattgaagatggggcatatcagagcctaagccacctctcyaccttaatattgacaggaaaccccatccagagtttagccctgggagccttttctggactatcaagtttacagaagctggtggctgtggagacaaatctag

SEQ ID NO: 2230 - DNA, 201 bp, Homo sapiens; identical to SEQ ID NO: 2076

SEQ ID NO: 2231 - DNA, 201 bp, Homo sapiens; identical to SEQ ID NO: 2077

SEQ ID NO: 2232 - DNA, 201 bp, Homo sapiens; identical to SEQ ID NO: 2129

SEQ ID NO: 2233 - DNA, 201 bp, Homo sapiens; identical to SEQ ID NO: 2078

SEQ ID NO: 2234 - DNA, 201 bp, Homo sapiens; identical to SEQ ID NO: 2079

SEQ ID NO: 2235 - DNA, 201 bp, Homo sapiens; identical to SEQ ID NO: 2080

SEQ ID NO: 2236 - DNA, 201 bp, Homo sapiens; identical to SEQ ID NO: 2081

SEQ ID NO: 2237 - DNA, 201 bp, Homo sapiens; identical to SEQ ID NO: 2082

SEQ ID NO: 2238 - DNA, 201 bp, Homo sapiens; identical to SEQ ID NO: 2083

SEQ ID NO: 2239 - DNA, 201 bp, Homo sapiens; identical to SEQ ID NO: 2084

SEQ ID NO: 2240 - DNA, 201 bp, Homo sapiens; identical to SEQ ID NO: 2085

SEQ ID NO: 2241 - DNA, 201 bp, Homo sapiens; identical to SEQ ID NO: 2086

SEQ ID NO: 2242 - DNA, 201 bp, Homo sapiens; identical to SEQ ID NO: 2087

SEQ ID NO: 2243 - DNA, 201 bp, Homo sapiens; identical to SEQ ID NO: 2088

SEQ ID NO: 2244 - DNA, 201 bp, Homo sapiens; identical to SEQ ID NO: 2089

SEQ ID NO: 2245 - DNA, 201 bp, Homo sapiens; identical to SEQ ID NO: 2090

SEQ ID NO: 2246 - DNA, 201 bp, Homo sapiens; identical to SEQ ID NO: 2091

SEQ ID NO: 2247 - DNA, 201 bp, Homo sapiens; identical to SEQ ID NO: 2092

SEQ ID NO: 2248 - DNA, 201 bp, Homo sapiens; identical to SEQ ID NO: 2093

SEQ ID NO: 2249 - DNA, 201 bp, Homo sapiens; identical to SEQ ID NO: 2094

SEQ ID NO: 2250 - DNA, 201 bp, Homo sapiens; identical to SEQ ID NO: 2095

SEQ ID NO: 2251 - DNA, 201 bp, Homo sapiens; identical to SEQ ID NO: 2096

SEQ ID NO: 2252 - DNA, 201 bp, Homo sapiens; identical to SEQ ID NO: 2097

SEQ ID NO: 2253 - DNA, 201 bp, Homo sapiens; identical to SEQ ID NO: 2098

SEQ ID NO: 2254 - DNA, 201 bp, Homo sapiens; identical to SEQ ID NO: 2099

SEQ ID NO: 2255 - DNA, 201 bp, Homo sapiens; identical to SEQ ID NO: 2100

SEQ ID NO: 2256 - DNA, 201 bp, Homo sapiens; identical to SEQ ID NO: 2101

SEQ ID NO: 2257 - DNA, 201 bp, Homo sapiens; identical to SEQ ID NO: 2102

SEQ ID NO: 2258 - DNA, 201 bp, Homo sapiens; identical to SEQ ID NO: 2103

SEQ ID NO: 2259 - DNA, 201 bp, Homo sapiens; identical to SEQ ID NO: 2104

SEQ ID NO: 2260 - DNA, 201 bp, Homo sapiens; identical to SEQ ID NO: 2105

SEQ ID NO: 2261 - DNA, 201 bp, Homo sapiens; identical to SEQ ID NO: 2106

SEQ ID NO: 2262 - DNA, 201 bp, Homo sapiens; identical to SEQ ID NO: 2107

SEQ ID NO: 2263 - DNA, 201 bp, Homo sapiens; identical to SEQ ID NO: 2108

SEQ ID NO: 2264 - DNA, 201 bp, Homo sapiens; identical to SEQ ID NO: 2109

SEQ ID NO: 2265 - DNA, 201 bp, Homo sapiens; identical to SEQ ID NO: 2110

SEQ ID NO: 2266 - DNA, 201 bp, Homo sapiens; identical to SEQ ID NO: 2111

SEQ ID NO: 2267 - DNA, 201 bp, Homo sapiens; identical to SEQ ID NO: 2112

SEQ ID NO: 2268 - DNA, 201 bp, Homo sapiens; identical to SEQ ID NO: 2113

SEQ ID NO: 2269 - DNA, 201 bp, Homo sapiens; identical to SEQ ID NO: 2114

SEQ ID NO: 2270 - DNA, 201 bp, Homo sapiens; identical to SEQ ID NO: 2115

SEQ ID NO: 2271 - DNA, 201 bp, Homo sapiens; identical to SEQ ID NO: 2116

SEQ ID NO: 2272 - DNA, 201 bp, Homo sapiens; identical to SEQ ID NO: 2117

SEQ ID NO: 2273 - DNA, 201 bp, Homo sapiens; identical to SEQ ID NO: 2118

SEQ ID NO: 2274 - DNA, 201 bp, Homo sapiens; identical to SEQ ID NO: 2119

SEQ ID NO: 2275 - DNA, 201 bp, Homo sapiens; identical to SEQ ID NO: 2120

SEQ ID NO: 2276 - DNA, 201 bp, Homo sapiens; identical to SEQ ID NO: 2121

SEQ ID NO: 2277 - DNA, 201 bp, Homo sapiens; identical to SEQ ID NO: 2122

SEQ ID NO: 2278 - DNA, 154 bp, Homo sapiens; identical to SEQ ID NO: 2123

SEQ ID NO: 2279 - DNA, 201 bp, Homo sapiens
catcaacggcaggaaattctaagaaactgtagtgaaaagtacatcatgcaaaatgacaactacttaaaagagcagattttgacaaataagactttaaaatwtgacgttctcaaaaatagctttcagcagaaaaaggaactggattcacgccttatacaaaagaacagatgtcatagagaaaatgagatcgtttttaaagtt

SEQ ID NO: 2280 - DNA, 201 bp, Homo sapiens
gcaaaatgacaactacttaaaagagcagattttgacaaataagactttaaaatatgacgttctcaaaaatagctttcagcagaaaaaggaactggattcaygccttatacaaaagaacagatgtcatagagaaaatgagatcgtttttaaagttttgcaaaatacaggcaaattctctgaagaccacgggtcctgttgtgg

SEQ ID NO: 2281 - DNA, 201 bp, Homo sapiens
aaattctctgaagaccacgggtcctgttgtggagtaaactgttattattttaccatgcagaagaaagactggaagggatgtaaacagacttgtcaacattrtagatcatcccttttgaagatagatgacaaagatgaactcgtattttacattcacttttattctcttggactctgtttctcaatgttggacctaagatat

SEQ ID NO: 2282 - DNA, 201 bp, Homo sapiens
gactttaaaatatgacgttctcaaaaatagctttcagcagaaaaaggaactggattcacgccttatacaaaagaacagatgtcatagagaaaatgagatcrtttttaaagttttgcaaaatacaggcaaattctctgaagaccacgggtcctgttgtggagtaaactgttattattttaccatgcagaagaaagactggaa

SEQ ID NO: 2283 - DNA, 201 bp, Homo sapiens
ttattcaaccctgagatttttgcagtctccttcagagtcacagaatagattaaggcctgatgatactcaaaggcctgggaaaactgatgacaaagaatttycagtgccctggcacctcattgcagtgactcttgggatcctctgtttacttcttctgatgatagtcacagtgttggtgacaaatatctttcagtgtattca

SEQ ID NO: 2284 - DNA, 201 bp, Homo sapiens
aaagaattttcagtgccctggcacctcattgcagtgactcttgggatcctctgtttacttcttctgatgatagtcacagtgttggtgacaaatatctttcrgtgtattcaagaaaaacatcaacggcaggaaattctaagaaactgtagtgaaaagtacatcatgcaaaatgacaactacttaaaagagcagattttgaca

SEQ ID NO: 2285 - DNA, 201 bp, Homo sapiens
gtcaacattgtagatcatcccttttgaagatagatgacaaagatgaactcgtattttacattcacttttattctcttggactctgtttctcaatgttggasctaagatattgaagacaggctggagcccagagccttcattcaatctcagatttatgaaaataattactggattggattatcatatgatgaaagggaaagt

SEQ ID NO: 2286 - DNA, 201 bp, Homo sapiens
agatgtcatagagaaaatgagatcgtttttaaagttttgcaaaatacaggcaaattctctgaagaccacgggtcctgttgtggagtaaactgttattattytaccatgcagaagaaagactggaagggatgtaaacagacttgtcaacattgtagatcatcccttttgaagatagatgacaaagatgaactcgtattttac

SEQ ID NO: 2287 - DNA, 201 bp, Homo sapiens
tgatgacaaagaattttcagtgccctggcacctcattgcagtgactcttgggatcctctgtttacttcttctgatgatagtcacagtgttggtgacaaatrtctttcagtgtattcaagaaaaacatcaacggcaggaaattctaagaaactgtagtgaaaagtacatcatgcaaaatgacaactacttaaaagagcagat

SEQ ID NO: 2288 - DNA, 201 bp, Homo sapiens
tgaagatagatgacaaagatgaactcgtattttacattcacttttattctcttggactctgtttctcaatgttggacctaagatattgaagacaggctggwgcccagagccttcattcaatctcagatttatgaaaataattactggattggattatcatatgatgaaagggaaagtaagtggaaatggattgataatggc

SEQ ID NO: 2289 - DNA, 201 bp, Homo sapiens; identical to SEQ ID NO: 2279

SEQ ID NO: 2290 - DNA, 201 bp, Homo sapiens; identical to SEQ ID NO: 2280

SEQ ID NO: 2291 - DNA, 201 bp, Homo sapiens
aaattctctgaagaccacgggtcctgttgtggagtaaactgttattattttaccatgcagaagaaagactggaagggatgtaaacagacttgtcaacattrtagatcatcccttttgaagatagatgacaaagatgaactcgccttcattcaatctcagatttatgaaaataattactggattggattatcatatgatgaa

SEQ ID NO: 2292 - DNA, 201 bp, Homo sapiens; identical to SEQ ID NO: 2282

SEQ ID NO: 2293 - DNA, 201 bp, Homo sapiens; identical to SEQ ID NO: 2283

SEQ ID NO: 2294 - DNA, 201 bp, Homo sapiens; identical to SEQ ID NO: 2284

SEQ ID NO: 2295 - DNA, 201 bp, Homo sapiens
agatgtcatagagaaaatgagatcgtttttaaagttttgcaaaatacaggcaaattctctgaagaccacgggtcctgttgtggagtaaactgttattattytaccatgcagaagaaagactggaagggatgtaaacagacttgtcaacattgtagatcatcccttttgaagatagatgacaaagatgaactcgccttcatt

SEQ ID NO: 2296 - DNA, 201 bp, Homo sapiens; identical to SEQ ID NO: 2287

SEQ ID NO: 2297 - DNA, 201 bp, Homo sapiens; identical to SEQ ID NO: 2279

SEQ ID NO: 2298 - DNA, 201 bp, Homo sapiens; identical to SEQ ID NO: 2280

SEQ ID NO: 2299 - DNA, 201 bp, Homo sapiens; identical to SEQ ID NO: 2281

SEQ ID NO: 2300 - DNA, 201 bp, Homo sapiens; identical to SEQ ID NO: 2282

SEQ ID NO: 2301 - DNA, 201 bp, Homo sapiens; identical to SEQ ID NO: 2283

SEQ ID NO: 2302 - DNA, 201 bp, Homo sapiens; identical to SEQ ID NO: 2284

SEQ ID NO: 2303 - DNA, 201 bp, Homo sapiens; identical to SEQ ID NO: 2285

SEQ ID NO: 2304 - DNA, 201 bp, Homo sapiens; identical to SEQ ID NO: 2286

SEQ ID NO: 2305 - DNA, 201 bp, Homo sapiens; identical to SEQ ID NO: 2287

SEQ ID NO: 2306 - DNA, 201 bp, Homo sapiens; identical to SEQ ID NO: 2288

SEQ ID NO: 2307 - DNA, 201 bp, Homo sapiens
gcaattatcaaactcaggaaatttagcattagtacagtactatgatctaatctgtaatccatgttcaaattttgtcaattgtcccaataatgccatttatrtgtatttcttaaaaatccatgttcaggataattcaatgcatttgattgtaatgtctctttagtcttctttaatctgaaacagttctttaggctttttctt

SEQ ID NO: 2308 - DNA, 201 bp, Homo sapiens
aaattagttaaaaagaagtggaatcttgatgagctgcctaaatttgagaagaatttttatcaagagcaccctgatttggctaggcgcacagcacaagaggyggaaacatacagaagaagcaaggaaattacagttagaggtcacaactgcccgaagccagttctaaatttttatgaagccaatttccctgcaaatgtcatg

SEQ ID NO: 2309 - DNA, 201 bp, Homo sapiens
gaaaaaccaatctgagaagaacaacctaccttgtccttgatgaagcagatagaatgcttgatatgggctttgaaccccaaataaggaagattgtggatcarataagacctgataggcaaactctaatgtggagtgcgacttggccaaaagaagtaagacagcttgctgaagatttcctgaaagactatattcatataaaca

SEQ ID NO: 2310 - DNA, 201 bp, Homo sapiens
ttggtgcacttgaactgagtgcaaaccacaacattcttcagattgtggatgtgtgtcatgacgtagaaaaggatgaaaaacttattcgtctaatggaagakatcatgagtgagaaggagaataaaaccattgtttttgtggaaaccaaaagaagatgtgatgagcttaccagaaaaatgaggagagatgggtggcctgcca

SEQ ID NO: 2311 - DNA, 162 bp, Homo sapiens
caggacgtgaaacgggggcggtttgggaagtttagagaccattctccgccgaccaaaacccstcaaaggattatcagacacgcgggtcggacggtccacatcagccggcagcccgggcgggtcccggggtgcgagcagcgcacttccgtagtgcagcttcgg

SEQ ID NO: 2312 - DNA, 201 bp, Homo sapiens
gcaatacggaagtaatgttccaaatatgcacaatggtatgaaccaacaggcatatgcatatcctgctactgcagctgcacctatgattggttatccaatgycaacaggatattcccaataagactttagaagtatatgtaaatgtctgtttttcataattgctctttatattgtgtgttatctgacaagatagttatttaa

SEQ ID NO: 2313 - DNA, 201 bp, Homo sapiens
cttattcgtctaatggaagagatcatgagtgagaaggagaataaaaccattgtttttgtggaaaccaaaagaagatgtgatgagcttaccagaaaaatgargagagatgggtggcctgccatgggtatccatggtgacaagagtcaacaagagcgtgactgggttctaaatgaattcaaacatggaaaagctcctattctg

SEQ ID NO: 2314 - DNA, 201 bp, Homo sapiens
acctaataacataaagcaagtgagcgaccttatctctgtgcttcgtgaagctaatcaagcaattaatcccaagttgcttcagttggtcgaagacagaggtkcaggtcgttccaggggtagaggaggcatgaaggatgaccgtcgggacagatactctgcgggcaaaaggggtggatttaatacctttagagacagggaaaa

SEQ ID NO: 2315 - DNA, 201 bp, Homo sapiens
aatatgcacaatggtatgaaccaacaggcatatgcatatcctgctactgcagctgcacctatgattggttatccaatgccaacaggatattcccaataagmctttagaagtatatgtaaatgtctgtttttcataattgctctttatattgtgtgttatctgacaagatagttatttaagaaacatgggaattgcagaaat

SEQ ID NO: 2316 - DNA, 201 bp, Homo sapiens
caatgccaacaggatattcccaataagactttagaagtatatgtaaatgtctgtttttcataattgctctttatattgtgtgttatctgacaagatagttrtttaagaaacatgggaattgcagaaatgactgcagtgcagcagtaattatggtgcactttttcgctatttaagttggatatttctctacattcctgaaac

SEQ ID NO: 2317 - DNA, 201 bp, Homo sapiens
gaagtatatgtaaatgtctgtttttcataattgctctttatattgtgtgttatctgacaagatagttatttaagaaacatgggaattgcagaaatgactgyagtgcagcagtaattatggtgcactttttcgctatttaagttggatatttctctacattcctgaaacaatttttaggttttttttgtactagaaaatgca

SEQ ID NO: 2318 - DNA, 201 bp, Homo sapiens
tttccaataattcagggaattctagagatcctcaaactgtaaggtctattcatactcaacacaaggaaaaaacctcattaaaattaatgactaatcaggargcaacgtaaccaaaagcacagtgaatgaaagttttcatggtaggttcaacatgggtttattgctagaaagatccaggggatagctttaggtttaacttcg

SEQ ID NO: 2319 - DNA, 201 bp, Homo sapiens; identical to SEQ ID NO: 2308

SEQ ID NO: 2320 - DNA, 200 bp, Homo sapiens
aggtcatagagcggctcccagcgttccctgcggcgtaggaggcggtccagactacaaaagcggctgccggaaagcggccggcacctcattcatttctacsggtctctagtagtgcagcttcggctggtgtcatcggtgtccttcctccgctgccgcccccgcaaggcttcgccgtcatcgaggccatttccagcgacttg

SEQ ID NO: 2321 - DNA, 201 bp, Homo sapiens; identical to SEQ ID NO: 2309

SEQ ID NO: 2322 - DNA, 201 bp, Homo sapiens; identical to SEQ ID NO: 2310

SEQ ID NO: 2323 - DNA, 155 bp, Homo sapiens
aggtcatagagcggctcccagcgttccctgcggcgtaggaggcggtccagactayaaaagcggctgccggaaagcggccggcacctcattcatttctaccggtctctagtagtgcagcttcggctggtgtcatcggtgtccttcctccgctgccg

SEQ ID NO: 2324 - DNA, 201 bp, Homo sapiens; identical to SEQ ID NO: 2312

SEQ ID NO: 2325 - DNA, 201 bp, Homo sapiens; identical to SEQ ID NO: 2313

SEQ ID NO: 2326 - DNA, 201 bp, Homo sapiens; identical to SEQ ID NO: 2314

SEQ ID NO: 2327 - DNA, 201 bp, Homo sapiens; identical to SEQ ID NO: 2315

SEQ ID NO: 2328 - DNA, 201 bp, Homo sapiens; identical to SEQ ID NO: 2316

SEQ ID NO: 2329 - DNA, 201 bp, Homo sapiens; identical to SEQ ID NO: 2317

SEQ ID NO: 2330 - DNA, 201 bp, Homo sapiens
ccttccaataaaaaatatttgaagactgaattaagtggaaattgtactttattttatataatgtcatgtaaaactttgcttaagatggtctggtttttttyttgtttttgtttggttttttttttccatgaaaacaaatgactgttcctttttatttaatttgggaggcagggggaatcagaaggcccttctttataatga

SEQ ID NO: 2331 - DNA, 201 bp, Homo sapiens
gaccgttgacacttctgccgaagacgtggccttcttcctggacgtctggtgggaggtgatgaagcacaagggtcacccgcaggaccccctgctctcccagyttagtgcaatggcccataagtacctgcctgccttagatgagttcccccatcctccaaagaggcttaggtcagacccagacgcgtgccccaccatgcccct

SEQ ID NO: 2332 - DNA, 201 bp, Homo sapiens
cttcatccagactctagaggcaaacgcgtgccgagaggaatactggctccagacctgctccccgtttccactcctcttcagcttgtgccagctcttggacygcttcagcaaatactggcagcttcccaaggagaagcggtgcctctctttggataggaaggatctagcgatccatatcctggagctcctgtgtgagattgt

SEQ ID NO: 2333 - DNA, 201 bp, Homo sapiens
accccctgctctcccagtttagtgcaatggcccataagtacctgcctgccttagatgagttcccccatcctccaaagaggcttaggtcagacccagacgcrtgccccaccatgcccctgttggccatgctgctccgcgggctgacacagatccagagtcggatcctgggcccggggaggaagtgctgtgcgctggccaacc

SEQ ID NO: 2334 - DNA, 201 bp, Homo sapiens
gctggagaagcagctcctccatgtcccttatagcctggaatatattcagtttgttcccctgctcaacctgaagccctttgcccaggagttgcaactctccrtcctcttcctgaggactttccagtttctctgcagccatagctgtcgtgattggcttcctctggaaggctggaaccacgtggtcaaactcctctgtggcag

SEQ ID NO: 2335 - DNA, 201 bp, Homo sapiens
cagagccatccctgagtctcagatccggcaggtgatccacctgatcctggaatgttacgcagacctctccctgccaggtaaaaataaagtccttgcaggtrtcctgcgttcctgggggcgaaagggcctctctgaaaagttgctggcttatgtggagggttttcaggaagacctcaatacaacttttaaccagctcactca

SEQ ID NO: 2336 - DNA, 201 bp, Homo sapiens
ggctgacacagatccagagtcggatcctgggcccggggaggaagtgctgtgcgctggccaacctggctgacatgctgactgtgtttgcgctgacagaggaygacccccaggaggtgtctgcaaccgtgtatctggacaaactggccacggtgatctctgtgtggaactcggacacccagaatccctaccaccagcaggcgc

SEQ ID NO: 2337 - DNA, 201 bp, Homo sapiens
gtttgttcccctgctcaacctgaagccctttgcccaggagttgcaactctccgtcctcttcctgaggactttccagtttctctgcagccatagctgtcgtrattggcttcctctggaaggctggaaccacgtggtcaaactcctctgtggcagtctgacccgcctcctggactcagtcagggcgatacaggcagctggccc

SEQ ID NO: 2338 - DNA, 201 bp, Homo sapiens
gaccgcttcagcaaatactggcagcttcccaaggagaagcggtgcctctctttggataggaaggatctagcgatccatatcctggagctcctgtgtgagaytgtatcagccaatgctgagaccttctccccggatgtctggatcaagtccctgtcctggctccaccgcaagttagaacagctagactggactgtgggcctg

SEQ ID NO: 2339 - DNA, 201 bp, Homo sapiens
gtggcctccgtggcccgcctggtcatagtgcacccggaagtcacggtgaagaaaatgtgcagcctggctgtggtcaatctcggcacccacaagttcctggsccagattctcactgccttccctgcccttaggtttgtggaagagcagggtcccaattcatctgccactttcatggtgtcatgcctcaaagaaaccgtctgg

SEQ ID NO: 2340 - DNA, 201 bp, Homo sapiens
ttttgagatctgtaagctttcagaagacgagtggacctcccaggcccacccagggtacggggctggcacggggctcctggcctggatggagtgctgctgcktctccagcggcatctcggagaggatgctgtctctcttggtggtggacgtgggcaatcctgaggaggtcagactgttcagcaaaggctttctggtggccct

SEQ ID NO: 2341 - DNA, 201 bp, Homo sapiens
gtgctgaaggaatttgtcctgcctttcttgaggttagatgttgaagaggtagacctcagtctgaggatcttcatccagactctagaggcaaacgcgtgccragaggaatactggctccagacctgctccccgtttccactcctcttcagcttgtgccagctcttggaccgcttcagcaaatactggcagcttcccaaggag

SEQ ID NO: 2342 - DNA, 201 bp, Homo sapiens
tgtcctggctccaccgcaagttagaacagctagactggactgtgggcctgaggctgaagagcttcttcgaggggcacttcaagtgtgaagtgccagccacrctttttgagatctgtaagctttcagaagacgagtggacctcccaggcccacccagggtacggggctggcacggggctcctggcctggatggagtgctgct

SEQ ID NO: 2343 - DNA, 201 bp, Homo sapiens
cggatgtctggatcaagtccctgtcctggctccaccgcaagttagaacagctagactggactgtgggcctgaggctgaagagcttcttcgaggggcacttsaagtgtgaagtgccagccacactttttgagatctgtaagctttcagaagacgagtggacctcccaggcccacccagggtacggggctggcacggggctcc

SEQ ID NO: 2344 - DNA, 201 bp, Homo sapiens
aaggagaagcggtgcctctctttggataggaaggatctagcgatccatatcctggagctcctgtgtgagattgtatcagccaatgctgagaccttctcccyggatgtctggatcaagtccctgtcctggctccaccgcaagttagaacagctagactggactgtgggcctgaggctgaagagcttcttcgaggggcacttc

SEQ ID NO: 2345 - DNA, 201 bp, Homo sapiens
agtggggggaggagttgcaggccgtgctccgcagcagccaggggacaagttacgacagctaccggctgtgcgacagtctgacttccttcagccagaacgcracgctctacctgaaccgcaccagcctgtccaaggaggacaggcaggtggtctctgagctggcggagtgtgtcagggacttcctgaggaaaacgagcacgg

SEQ ID NO: 2346 - DNA, 201 bp, Homo sapiens
tcacctgctatgagactttgagcaagaccaacccttctgtcagctccttgctccagagggcacacgagcagtgcttcttaaagtccattgctgagggcatyggccctgaagaacggcgccaaaccctgttgcagaagatgagcagcttctgacttggcgtggggagctgggccccaacatggcgggtctgcagaagatcag

SEQ ID NO: 2347 - DNA, 201 bp, Homo sapiens
gccactctacgttttagccttggaaaccctcacctgctatgagactttgagcaagaccaacccttctgtcagctccttgctccagagggcacacgagcagygcttcttaaagtccattgctgagggcatcggccctgaagaacggcgccaaaccctgttgcagaagatgagcagcttctgacttggcgtggggagctgggc

SEQ ID NO: 2348 - DNA, 201 bp, Homo sapiens
acggtgaagaaaatgtgcagcctggctgtggtcaatctcggcacccacaagttcctgggccagattctcactgccttccctgcccttaggtttgtggaagwgcagggtcccaattcatctgccactttcatggtgtcatgcctcaaagaaaccgtctggatgaagttctctacacccaaggaagaaaagcaatttttagag

SEQ ID NO: 2349 - DNA, 201 bp, Homo sapiens
cggtgatctctgtgtggaactcggacacccagaatccctaccaccagcaggcgctggcagagaaggtgaaggaggcagaacgggatgtcagcctgacctcrctggccaaactccccagtgagaccattttcgtgggctgcgagttcctgcaccacctgctgcgggagtggggggaggagttgcaggccgtgctccgcagca

SEQ ID NO: 2350 - DNA, 201 bp, Homo sapiens
aaataaagtccttgcaggtatcctgcgttcctgggggcgaaagggcctctctgaaaagttgctggcttatgtggagggttttcaggaagacctcaatacawcttttaaccagctcactcagagtgcctccgaacagggcttggcaaaagctgtggcctccgtggcccgcctggtcatagtgcacccggaagtcacggtgaa

SEQ ID NO: 2351 - DNA, 201 bp, Homo sapiens
ccgccatatggaagtgtgctacatttttgcctctgagaagaagtgggccttctcggacgagtgggtagcctgcctggggagtaacagggccctcttccgasagccagacttggtgttgaggctgctggaaacagtgatagacgtcagcacagctgacagagccatccctgagtctcagatccggcaggtgatccacctgat

SEQ ID NO: 2352 - DNA, 172 bp, Homo sapiens
cgcggccgccgtggctcctgcgtctcccatcgtgccgtgcgtcccgcgccgcgttcgagttctcggaggggrgggggcgttagccccgcgcagccgccggcgtcgccgccatggacctaggacccttgaacatctgtgaagaaatgactattctgcatggaggcttcttgct

SEQ ID NO: 2353 - DNA, 201 bp, Homo sapiens
cctgaagaacggcgccaaaccctgttgcagaagatgagcagcttctgacttggcgtggggagctgggccccaacatggcgggtctgcagaagatcagcagmttcttacctgtgcgggagcgaaaaagctgggcttcaacatggcaggtctgtaggggtcagacccgagcagcctggactttacagttatgtgaaactgtcc

SEQ ID NO: 2354 - DNA, 201 bp, Homo sapiens
ggccccaacatggcgggtctgcagaagatcagcagcttcttacctgtgcgggagcgaaaaagctgggcttcaacatggcaggtctgtaggggtcagacccragcagcctggactttacagttatgtgaaactgtccacaaaaagtcatggcaataatggtgtaaagaaaatagtttcttgggtatttgtaacgtacaaact

SEQ ID NO: 2355 - DNA, 201 bp, Homo sapiens
acatggcgggtctgcagaagatcagcagcttcttacctgtgcgggagcgaaaaagctgggcttcaacatggcaggtctgtaggggtcagacccgagcagcmtggactttacagttatgtgaaactgtccacaaaaagtcatggcaataatggtgtaaagaaaatagtttcttgggtatttgtaacgtacaaactatcataa

SEQ ID NO: 2356 - DNA, 201 bp, Homo sapiens
ttcgcatctcactttgtctcttctaagtcggcctcagcaatagcccaggattaaatatgctctgaaattgggtttagtgtcttcaagatcaaatccagccrggaggaacatgttcataactggacttttccatcctagattttggcaaataagcccaaagttgaaaccatgtgagtggaaaaagcattacatggtacgtat

SEQ ID NO: 2357 - DNA, 201 bp, Homo sapiens; identical to SEQ ID NO: 2331

SEQ ID NO: 2358 - DNA, 201 bp, Homo sapiens
actgagttttgggcgactttgcattgagatcgccgagagctagggccatgagtaccttgtttttgactggaaggagctgtggggtggaccgtttccctgayagctagaagaatgtttgaagcctgttcccaaggacccttgaacatctgtgaagaaatgactattctgcatggaggcttcttgctggccgagcagctgttc

SEQ ID NO: 2359 - DNA, 201 bp, Homo sapiens; identical to SEQ ID NO: 2332

SEQ ID NO: 2360 - DNA, 201 bp, Homo sapiens; identical to SEQ ID NO: 2333

SEQ ID NO: 2361 - DNA, 201 bp, Homo sapiens; identical to SEQ ID NO: 2334

SEQ ID NO: 2362 - DNA, 201 bp, Homo sapiens; identical to SEQ ID NO: 2335

SEQ ID NO: 2363 - DNA, 201 bp, Homo sapiens; identical to SEQ ID NO: 2336

SEQ ID NO: 2364 - DNA, 201 bp, Homo sapiens
cgacagagcggggagaatggaagtgtgtctccccactgagttttgggcgactttgcattgagatcgccgagagctagggccatgagtaccttgtttttgaytggaaggagctgtggggtggaccgtttccctgaaagctagaagaatgtttgaagcctgttcccaaggacccttgaacatctgtgaagaaatgactattct

SEQ ID NO: 2365 - DNA, 201 bp, Homo sapiens; identical to SEQ ID NO: 2337

SEQ ID NO: 2366 - DNA, 201 bp, Homo sapiens; identical to SEQ ID NO: 2338

SEQ ID NO: 2367 - DNA, 201 bp, Homo sapiens; identical to SEQ ID NO: 2339

SEQ ID NO: 2368 - DNA, 201 bp, Homo sapiens; identical to SEQ ID NO: 2340

SEQ ID NO: 2369 - DNA, 201 bp, Homo sapiens; identical to SEQ ID NO: 2341

SEQ ID NO: 2370 - DNA, 201 bp, Homo sapiens; identical to SEQ ID NO: 2342

SEQ ID NO: 2371 - DNA, 201 bp, Homo sapiens; identical to SEQ ID NO: 2343

SEQ ID NO: 2372 - DNA, 201 bp, Homo sapiens; identical to SEQ ID NO: 2344

SEQ ID NO: 2373 - DNA, 201 bp, Homo sapiens; identical to SEQ ID NO: 2345

SEQ ID NO: 2374 - DNA, 201 bp, Homo sapiens; identical to SEQ ID NO: 2346

SEQ ID NO: 2375 - DNA, 201 bp, Homo sapiens; identical to SEQ ID NO: 2347

SEQ ID NO: 2376 - DNA, 201 bp, Homo sapiens; identical to SEQ ID NO: 2348

SEQ ID NO: 2377 - DNA, 201 bp, Homo sapiens; identical to SEQ ID NO: 2349

SEQ ID NO: 2378 - DNA, 201 bp, Homo sapiens
tgagttttgggcgactttgcattgagatcgccgagagctagggccatgagtaccttgtttttgactggaaggagctgtggggtggaccgtttccctgaaarctagaagaatgtttgaagcctgttcccaaggacccttgaacatctgtgaagaaatgactattctgcatggaggcttcttgctggccgagcagctgttcca

SEQ ID NO: 2379 - DNA, 201 bp, Homo sapiens; identical to SEQ ID NO: 2350

SEQ ID NO: 2380 - DNA, 201 bp, Homo sapiens; identical to SEQ ID NO: 2351

SEQ ID NO: 2381 - DNA, 201 bp, Homo sapiens; identical to SEQ ID NO: 2353

SEQ ID NO: 2382 - DNA, 201 bp, Homo sapiens; identical to SEQ ID NO: 2354

SEQ ID NO: 2383 - DNA, 201 bp, Homo sapiens; identical to SEQ ID NO: 2355

SEQ ID NO: 2384 - DNA, 201 bp, Homo sapiens; identical to SEQ ID NO: 2356

SEQ ID NO: 2385 - DNA, 201 bp, Homo sapiens; identical to SEQ ID NO: 2331

SEQ ID NO: 2386 - DNA, 201 bp, Homo sapiens; identical to SEQ ID NO: 2332

SEQ ID NO: 2387 - DNA, 201 bp, Homo sapiens; identical to SEQ ID NO: 2333

SEQ ID NO: 2388 - DNA, 201 bp, Homo sapiens; identical to SEQ ID NO: 2334

SEQ ID NO: 2389 - DNA, 201 bp, Homo sapiens; identical to SEQ ID NO: 2335

SEQ ID NO: 2390 - DNA, 201 bp, Homo sapiens; identical to SEQ ID NO: 2336

SEQ ID NO: 2391 - DNA, 201 bp, Homo sapiens; identical to SEQ ID NO: 2337

SEQ ID NO: 2392 - DNA, 201 bp, Homo sapiens; identical to SEQ ID NO: 2338

SEQ ID NO: 2393 - DNA, 201 bp, Homo sapiens; identical to SEQ ID NO: 2339

SEQ ID NO: 2394 - DNA, 201 bp, Homo sapiens; identical to SEQ ID NO: 2340

SEQ ID NO: 2395 - DNA, 201 bp, Homo sapiens; identical to SEQ ID NO: 2341

SEQ ID NO: 2396 - DNA, 201 bp, Homo sapiens; identical to SEQ ID NO: 2342

SEQ ID NO: 2397 - DNA, 201 bp, Homo sapiens; identical to SEQ ID NO: 2343

SEQ ID NO: 2398 - DNA, 201 bp, Homo sapiens; identical to SEQ ID NO: 2344

SEQ ID NO: 2399 - DNA, 201 bp, Homo sapiens; identical to SEQ ID NO: 2345

SEQ ID NO: 2400 - DNA, 201 bp, Homo sapiens; identical to SEQ ID NO: 2346

SEQ ID NO: 2401 - DNA, 201 bp, Homo sapiens; identical to SEQ ID NO: 2347

SEQ ID NO: 2402 - DNA, 201 bp, Homo sapiens; identical to SEQ ID NO: 2348

SEQ ID NO: 2403 - DNA, 201 bp, Homo sapiens; identical to SEQ ID NO: 2349

SEQ ID NO: 2404 - DNA, 201 bp, Homo sapiens; identical to SEQ ID NO: 2350

SEQ ID NO: 2405 - DNA, 201 bp, Homo sapiens; identical to SEQ ID NO: 2351

SEQ ID NO: 2406 - DNA, 201 bp, Homo sapiens; identical to SEQ ID NO: 2353

SEQ ID NO: 2407 - DNA, 201 bp, Homo sapiens; identical to SEQ ID NO: 2354

SEQ ID NO: 2408 - DNA, 201 bp, Homo sapiens; identical to SEQ ID NO: 2355

SEQ ID NO: 2409 - DNA, 201 bp, Homo sapiens; identical to SEQ ID NO: 2356

SEQ ID NO: 2410 - DNA, 112 bp, Homo sapiens
gatctcacccarggtggcagaaggaggccttctggagctgacccacccccgacgaccatcagggtgaggcaactccaaggtcctactctctttctgtgcctgttacccaccc

SEQ ID NO: 2411 - DNA, 201 bp, Homo sapiens
gggaaactatgttttccccaagtggggccagggtgtgggctggctgatggctctgtcttccatggtcctcatccccgggtacatggcctacatgttcctcrccttaaagggctccctgaagcagcgcatccaagtcatggtccagcccagcgaagacatcgttcgcccagagaatggtcctgagcagccccaggcgggcag

SEQ ID NO: 2412 - DNA, 201 bp, Homo sapiens
tagggtgcccttgagccgcaaaactgctgtccacgtggaccgggggtgacatcgcacgtccatctgccaggacccctgcgtccaaattccgagacatggcraccaacggcagcaaggtggccgacgggcagatctccaccgaggtcagcgaggcccctgtggccaatgacaagcccaaaaccttggtggtcaaggtgcaga

SEQ ID NO: 2413 - DNA, 201 bp, Homo sapiens
ctgtgcagatgacgccactcaccatgggaaactatgttttccccaagtggggccagggtgtgggctggctgatggctctgtcttccatggtcctcatcccygggtacatggcctacatgttcctcaccttaaagggctccctgaagcagcgcatccaagtcatggtccagcccagcgaagacatcgttcgcccagagaatg

SEQ ID NO: 2414 - DNA, 201 bp, Homo sapiens
gctgcatcaattcgtgcaccagcatgttcgcaggattcgtcatcttctccatcgtgggcttcatggcccatgtcaccaagaggtccattgctgatgtggcsgcctcaggccccgggctggcgttcctggcatacccagaggcggtgacccagctgcctatctccccactctgggccatcctcttcttctccatgctgttga

SEQ ID NO: 2415 - DNA, 201 bp, Homo sapiens
ggtccctgatcgctctcgggagctacaactctttccacaacaatgtctacagggactccatcatcgtctgctgcatcaattcgtgcaccagcatgttcgcrggattcgtcatcttctccatcgtgggcttcatggcccatgtcaccaagaggtccattgctgatgtggcggcctcaggccccgggctggcgttcctggcat

SEQ ID NO: 2416 - DNA, 201 bp, Homo sapiens
tcccactcttcctgctggagtgctccctgggccagtacacctccatcggggggctaggggtatggaagctggctcctatgttcaagggcgtgggccttgcrgctgctgtgctatcattctggctgaacatctactacatcgtcatcatctcctgggccatttactacctgtacaactccttcaccacgacactgccgtgga

SEQ ID NO: 2417 - DNA, 201 bp, Homo sapiens
acatgaccagcgctgtggtggagttctgggagcgcaacatgcatcagatgacggacgggctggataagccaggtcagatccgctggccactggccatcackctggccatcgcctggatccttgtgtatttctgtatctggaagggtgttggctggactggaaaggtggtctacttttcagccacatacccctacatcatgc

SEQ ID NO: 2418 - DNA, 201 bp, Homo sapiens
tctgtatctggaagggtgttggctggactggaaaggtggtctacttttcagccacatacccctacatcatgctgatcatcctgttcttccgtggagtgacrctgcccggggccaaggagggcatcctcttctacatcacacccaacttccgcaagctgtctgactccgaggtgtggctggatgcggcaacccagatcttct

SEQ ID NO: 2419 - DNA, 201 bp, Homo sapiens
gggccactcaccgacccgacactctcaccccccgacctggctgagtgcgaccaccacttgatgtctgaggataccttccatctcaacctacctcgagtggygagtccagacaccatcaccacgcagagaggggaggtgggaggacagttagacccctgggtgggccctgccgtgggcaaggatacccggtggcttctggca

SEQ ID NO: 2420 - DNA, 201 bp, Homo sapiens
cacgcagagaggggaggtgggaggacagttagacccctgggtgggccctgccgtgggcaaggatacccggtggcttctggcacctggcgggctggtgaccwttttaatccaggccccatcagcatcccacgatcggccttggtaaccgccgcggtagatcatttttatcccgccagggagtgtgatgcaggaagaccacat

SEQ ID NO: 2421 - DNA, 201 bp, Homo sapiens
gaccacatgcgctcctggcttttaaacctgttcctgactgttctcttactgccgaaacccttgactgttatctcggactttgcaggagttcctttccctcygaacgctgctccatgcacaggaaaagggcattttgtacaatggggacttcccgggaacgcttgctcttaagtaccagaagccggcggagctctggctttc

SEQ ID NO: 2422 - DNA, 201 bp, Homo sapiens
ggagctctggctttcgtgtttttggttttctccttcccaaggcagctggattgaaaaaacaaaacaaaacaaaaaaacccaggggcgtcagtcgatattcycagggccgcttctcctgcagtctgtggagcgtccttgtccccgccgccggaatgaatgagcattctgcagcccgatgtccctgtcccctcctcgccgggc

SEQ ID NO: 2423 - DNA, 201 bp, Homo sapiens
cacaagcacaattgatctctttttatcgccattccaggggcctcaggtcctactggggaaacttcctataccggagctccagtttctcttaagctgcccartttcacagagtacaaaatagttgtaggggaaatcaaggtgaaggatctgtccgacagtcaagacggatccacagtaatctttcggtctccttaaactacc

SEQ ID NO: 2424 - DNA, 201 bp, Homo sapiens
gtctccttaaactaccaccctcgctgccacccaccccaagctgctgccgcctcaccttccttgaaatttctcagcgggagtctcctcactgccactaaaayccacccagcccactaactgaggagctagtgttaatccagagaaccccccgcaatgtgcttccgagattcagactgcttcattgggaagtatgatttgttc

SEQ ID NO: 2425 - DNA, 201 bp, Homo sapiens
ttgcaataagatattaccctcagaatattaagcacattattgtagagaaaaaaaaatatgtgtacacatatgaacgcacaacatgcacattcatcctcacrtgtggcacgtaaggtctcatttgatattgtgtaggaaatctgaagccttttcctgaggtcatctgtaaaatagtctcattgccaaggcatccccagtgcc

SEQ ID NO: 2426 - DNA, 201 bp, Homo sapiens
agcccgagcggccccgcgtcccgagcgcatcggagcggccgagccgcccggtgcagcgcctgtcccgggcagcgcagccccggccgcaggatctcacccarggtggcagaaggaggccttctggagctgacccacccccgacgaccatcagggtgaggcaactccaaggtcctactctctttctgtgcctgttacccaccc

SEQ ID NO: 2427 - DNA, 151 bp, Homo sapiens
ccctccgcccgccctcggaagaccgagacagcggagaggttgcgggtgacsgcgctgagcccaggagccgaggagtcgggagcgcagcgcagcccgagcccgagcccgagcggccccgcgtcccgagcgcatcggagcggccgagccgccc

SEQ ID NO: 2428 - DNA, 201 bp, Homo sapiens; identical to SEQ ID NO: 2411

SEQ ID NO: 2429 - DNA, 201 bp, Homo sapiens; identical to SEQ ID NO: 2412

SEQ ID NO: 2430 - DNA, 201 bp, Homo sapiens; identical to SEQ ID NO: 2413

SEQ ID NO: 2431 - DNA, 201 bp, Homo sapiens; identical to SEQ ID NO: 2414

SEQ ID NO: 2432 - DNA, 201 bp, Homo sapiens; identical to SEQ ID NO: 2415

SEQ ID NO: 2433 - DNA, 149 bp, Homo sapiens
ccctccgcccgccctcggaagaccgagacagcggagaggttgcgggtgsctgcgctgagcccaggagccgaggagtcgggagcgcagcgcagcccgagcccgagcccgagcggccccgcgtcccgagcgcatcggagcggccgagccgc

SEQ ID NO: 2434 - DNA, 201 bp, Homo sapiens; identical to SEQ ID NO: 2416

SEQ ID NO: 2435 - DNA, 165 bp, Homo sapiens
ccctccgcccgccctcggaagaccgagacagcggagaggttgcgggtgactgcgctgagcccagragccgaggagtcgggagcgcagcgcagcccgagcccgagcccgagcggccccgcgtcccgagcgcatcggagcggccgagccgcccggtgcagcgcctgt

SEQ ID NO: 2436 - DNA, 201 bp, Homo sapiens; identical to SEQ ID NO: 2417

SEQ ID NO: 2437 - DNA, 201 bp, Homo sapiens; identical to SEQ ID NO: 2418

SEQ ID NO: 2438 - DNA, 201 bp, Homo sapiens; identical to SEQ ID NO: 2419

SEQ ID NO: 2439 - DNA, 201 bp, Homo sapiens; identical to SEQ ID NO: 2420

SEQ ID NO: 2440 - DNA, 201 bp, Homo sapiens; identical to SEQ ID NO: 2421

SEQ ID NO: 2441 - DNA, 201 bp, Homo sapiens; identical to SEQ ID NO: 2422

SEQ ID NO: 2442 - DNA, 201 bp, Homo sapiens; identical to SEQ ID NO: 2423

SEQ ID NO: 2443 - DNA, 201 bp, Homo sapiens; identical to SEQ ID NO: 2425

SEQ ID NO: 2444 - DNA, 201 bp, Homo sapiens; identical to SEQ ID NO: 2426

SEQ ID NO: 2445 - DNA, 151 bp, Homo sapiens; identical to SEQ ID NO: 2427

SEQ ID NO: 2446 - DNA, 201 bp, Homo sapiens; identical to SEQ ID NO: 2411

SEQ ID NO: 2447 - DNA, 201 bp, Homo sapiens; identical to SEQ ID NO: 2412

SEQ ID NO: 2448 - DNA, 201 bp, Homo sapiens; identical to SEQ ID NO: 2413

SEQ ID NO: 2449 - DNA, 201 bp, Homo sapiens; identical to SEQ ID NO: 2414

SEQ ID NO: 2450 - DNA, 201 bp, Homo sapiens; identical to SEQ ID NO: 2415

SEQ ID NO: 2451 - DNA, 149 bp, Homo sapiens; identical to SEQ ID NO: 2433

SEQ ID NO: 2452 - DNA, 201 bp, Homo sapiens; identical to SEQ ID NO: 2416

SEQ ID NO: 2453 - DNA, 165 bp, Homo sapiens; identical to SEQ ID NO: 2435

SEQ ID NO: 2454 - DNA, 201 bp, Homo sapiens; identical to SEQ ID NO: 2417

SEQ ID NO: 2455 - DNA, 201 bp, Homo sapiens; identical to SEQ ID NO: 2418

SEQ ID NO: 2456 - DNA, 201 bp, Homo sapiens; identical to SEQ ID NO: 2419

SEQ ID NO: 2457 - DNA, 201 bp, Homo sapiens; identical to SEQ ID NO: 2420

SEQ ID NO: 2458 - DNA, 201 bp, Homo sapiens; identical to SEQ ID NO: 2421

SEQ ID NO: 2459 - DNA, 201 bp, Homo sapiens; identical to SEQ ID NO: 2422

SEQ ID NO: 2460 - DNA, 201 bp, Homo sapiens; identical to SEQ ID NO: 2423

SEQ ID NO: 2461 - DNA, 201 bp, Homo sapiens; identical to SEQ ID NO: 2424

SEQ ID NO: 2462 - DNA, 201 bp, Homo sapiens; identical to SEQ ID NO: 2425

SEQ ID NO: 2463 - DNA, 201 bp, Homo sapiens
agcccgagcggccccgcgtcccgagcgcatcggagcggccgagccgcccggtgcagcgcctgtcccgggcagcgcagccccggccgcaggatctcacccarggtggcagaaggaggccttctggagctgacccacccccgacgaccatcagggtgcccttgagccgcaaaactgctgtccacgtggaccgggggtgacatc

SEQ ID NO: 2464 - DNA, 151 bp, Homo sapiens; identical to SEQ ID NO: 2427

SEQ ID NO: 2465 - DNA, 201 bp, Homo sapiens; identical to SEQ ID NO: 2411

SEQ ID NO: 2466 - DNA, 201 bp, Homo sapiens
cagggtgcccttgagccgcaaaactgctgtccacgtggaccgggggtgacatcgcacgtccatctgccaggacccctgcgtccaaattccgagacatggcraccaacggcagcaaggtggccgacgggcagatctccaccgaggtcagcgaggcccctgtggccaatgacaagcccaaaaccttggtggtcaaggtgcaga

SEQ ID NO: 2467 - DNA, 201 bp, Homo sapiens; identical to SEQ ID NO: 2413

SEQ ID NO: 2468 - DNA, 201 bp, Homo sapiens; identical to SEQ ID NO: 2414

SEQ ID NO: 2469 - DNA, 201 bp, Homo sapiens; identical to SEQ ID NO: 2415

SEQ ID NO: 2470 - DNA, 149 bp, Homo sapiens; identical to SEQ ID NO: 2433

SEQ ID NO: 2471 - DNA, 201 bp, Homo sapiens; identical to SEQ ID NO: 2416

SEQ ID NO: 2472 - DNA, 165 bp, Homo sapiens; identical to SEQ ID NO: 2435

SEQ ID NO: 2473 - DNA, 201 bp, Homo sapiens; identical to SEQ ID NO: 2417

SEQ ID NO: 2474 - DNA, 201 bp, Homo sapiens; identical to SEQ ID NO: 2418

SEQ ID NO: 2475 - DNA, 201 bp, Homo sapiens; identical to SEQ ID NO: 2419

SEQ ID NO: 2476 - DNA, 201 bp, Homo sapiens; identical to SEQ ID NO: 2420

SEQ ID NO: 2477 - DNA, 201 bp, Homo sapiens; identical to SEQ ID NO: 2421

SEQ ID NO: 2478 - DNA, 201 bp, Homo sapiens; identical to SEQ ID NO: 2422

SEQ ID NO: 2479 - DNA, 201 bp, Homo sapiens; identical to SEQ ID NO: 2423

SEQ ID NO: 2480 - DNA, 201 bp, Homo sapiens; identical to SEQ ID NO: 2424

SEQ ID NO: 2481 - DNA, 201 bp, Homo sapiens; identical to SEQ ID NO: 2425

SEQ ID NO: 2482 - DNA, 108 bp, Homo sapiens
tggcctcyccggattctgttaacggtagtggtggcttgttgggatccgttgagtgatgggagagtgtgctctttaacttcggagagagatgcgctctcgtgtagccgt

SEQ ID NO: 2483 - DNA, 201 bp, Homo sapiens
gccccacattggaactaagacaggtttgtcaagggctatttaatgagttactagaaaatgggatttctgtgtggcctggttatttggaaactatgcagtcytcattggaacaactttattcgaagtatgatgaaatgagtattctcttcacagttttggttactgaaactactttggagaatggattaatacatctgagaa

SEQ ID NO: 2484 - DNA, 201 bp, Homo sapiens
gagagggaagcgaggcgctgttagagatctgtcagagaaggcatttcctaagtggaagcaagcagcagcttagccgggattctcttctgagtgggtgccaycccggcttcggacccttgggcgtagagttgcggaagaacctggccgcagaatggtggacctcggtggtggtgttcagggagcaggtattcccggtggacg

SEQ ID NO: 2485 - DNA, 201 bp, Homo sapiens
aggccctttgctacccggggacagtgccttcaggttagtttctgcagaaactctacgcgaaatcttgcaagacaaagagctgagtaaggaacagctagtarcatttcttgagaacgtattaaaaacttctgggaaactacgggagaaccttcttcacggtgccttggaacactatgttaattgcctggatctggtaaacaa

SEQ ID NO: 2486 - DNA, 201 bp, Homo sapiens
aagaatgtatagatttttatatttgtataataaatattcttctctcctaatttggttgtcttatgttcacttagatttatttctagcccctttgcacttayaaagtggacatttgtggtgcttgctttcattcagtgtttatattttttatgtctttcattgtatcaggaatatgttcagctacaagaaacaaaaatctac

SEQ ID NO: 2487 - DNA, 201 bp, Homo sapiens
tacacttcccttccttaaagatgaggttaaggtaaatgacttgctctggaatgcagattcctctgtgcttgcagtctggctggaagaccttcagagagaaraaagctccattccgaaaacctgtgttcagctctggactgttggaaactatcactggtatctcaagcaaagtttatccttcagcacctgtgggaagagcaa

SEQ ID NO: 2488 - DNA, 201 bp, Homo sapiens
cgcgtgcgcaattcggagccgactctgggtgcggactgtgggagctgactctgggtagccggctgcgcgtggctggggaggcgaggccggacgcacctctstttgggggtcctcagagattaatgattcatcaagggatagttgtacttgtctcgtgggaatcacttcatcatgcgaaatctgaaattatttcggaccctg

SEQ ID NO: 2489 - DNA, 201 bp, Homo sapiens
ggcctacaaagaaggccggccgccgtaagtgaccagaagcgggcccggcctcgccccctccgcctggtgacgtcactcccgcgccgcactcccagtgctgsggctgcctagttgacgcacccattgagtcgctggcttctttgcagcgcttcagcgttttcccctggagggcgcctccatccttggaggcctagtgccgtc

SEQ ID NO: 2490 - DNA, 201 bp, Homo sapiens
catcaggatgattttggtgaaagcaagtttatcactgttggatggggtaggaaggagacacagttccatggatcagaaggcagacaagcagcttttcagawgcaaatgcatgagtctgctttgccctgggatgaccatagaccacaagttacctggcggggggatggacagttttttgctgtgagtgttgtttgcccagaa

SEQ ID NO: 2491 - DNA, 201 bp, Homo sapiens
tctggtggatttcctgttcggtttccttatccatgcacccagaccgaattggccatgattggagaagaggaatgtgtccttggtctgactgacaggtgtcrctttttcatcaatgacattgaggttgcgtcaaatatcacgtcatttgcagtatatgatgagtttttattgttgacaacccattcccatacctgccagtgt

SEQ ID NO: 2492 - DNA, 201 bp, Homo sapiens
aagagtgtgcccaggattatgaagaagctgtgctcttgctgttagaaggagctgcctgggaagaagctttgaggctggtatacaaatataacagactggakattatagaaaccaacgtaaagccttccattttagaagcccagaaaaattatatggcatttctggactctcagacagccacattcagtcgccacaagaaac

SEQ ID NO: 2493 - DNA, 201 bp, Homo sapiens
taactttaccaaagaccagctggtgggcctcggcagaactctggcaggaaagctggttgagcagaggaagcacattgatgcggccatggttttggaagagwgtgcccaggattatgaagaagctgtgctcttgctgttagaaggagctgcctgggaagaagctttgaggctggtatacaaatataacagactggatattat

SEQ ID NO: 2494 - DNA, 201 bp, Homo sapiens
aatagaccttgtctgcgatgctatgagagcagtcatggagagcataaatcctcataaatactgcctatccatacttacatctcatgtaaagaagacaaccscagaactggaaattgtactgcaaaaagtacacgagcttcaaggaaatgctccctctgatcctgatgctgtgagtgctgaagaggccttgaaatatttgct

SEQ ID NO: 2495 - DNA, 201 bp, Homo sapiens
gttttttacagaattgaaagaagaagatgtcacgaagaccatgtaccctgcaccagttaccagcagtgtctacctgtccagggatcctgacgggaataaamtagaccttgtctgcgatgctatgagagcagtcatggagagcataaatcctcataaatactgcctatccatacttacatctcatgtaaagaagacaacccc

SEQ ID NO: 2496 - DNA, 201 bp, Homo sapiens
ctctgatgtgggaccctgtgaccccataccggctgcatgttctctgtcagggctggcattacctcgcctatgattggcactggacgactgaccggagcgtrggagataattcaagtgacttgtccaatgtggctgtcattgatggaaacagggtgttggtgacagtcttccggcagactgtggttccgcctcccatgtgca

SEQ ID NO: 2497 - DNA, 201 bp, Homo sapiens
ttggtctgactgacaggtgtcgctttttcatcaatgacattgaggttgcgtcaaatatcacgtcatttgcagtatatgatgagtttttattgttgacaacycattcccatacctgccagtgtttttgcctgagggatgcttcatttaaaacattacaggccggcctgagcagcaatcatgtgtcccatggggaagttctgc

SEQ ID NO: 2498 - DNA, 201 bp, Homo sapiens
tctcccagaggatggaagtggccgcattgttggtgttcaggacttgctggatcaggagtctgtgtgtgtggccacagcctctggagacgtcatactctgcrgtctcagcacacaacagctggagtgtgttgggagtgtagccagtggtatctctgttatgagttggagtcctgaccaagagctggtgcttcttgccacagg

SEQ ID NO: 2499 - DNA, 201 bp, Homo sapiens
ttgcttatggggagcacctgatgcaggagcacatgtatgagccagcggggctcatgtttgcccgttgcggtgcccacgagaaagctctctcagcctttctsacatgtggcaactggaagcaagccctctgtgtggcagcccagcttaactttaccaaagaccagctggtgggcctcggcagaactctggcaggaaagctgg

SEQ ID NO: 2500 - DNA, 201 bp, Homo sapiens
tggaaccgagagtttgctttgcagtcaaccagtgagcctgtggcaggactgggaccagccctggcttggaaaccctcaggcagtttgattgcatctacacragataaacccaaccagcaggatattgtgttttttgagaaaaatggactccttcatggacactttacacttcccttccttaaagatgaggttaaggtaaat

SEQ ID NO: 2501 - DNA, 201 bp, Homo sapiens
gagcaagattgtgtctctgatgtgggaccctgtgaccccataccggctgcatgttctctgtcagggctggcattacctcgcctatgattggcactggacgrctgaccggagcgtgggagataattcaagtgacttgtccaatgtggctgtcattgatggaaacagggtgttggtgacagtcttccggcagactgtggttcc

SEQ ID NO: 2502 - DNA, 201 bp, Homo sapiens
ccatttcttaatacacttaagaaaatggaaactaattatcagcggtttactatagacaaatacttgaaacgatatgaaaaagccattggccacctcagcawatgtggacctgagtacttcccagaatgcttaaacttgataaaagataaaaacttgtataacgaagctctgaagttatattcaccaagctcacaacagtac

SEQ ID NO: 2503 - DNA, 201 bp, Homo sapiens
tggttggacaaacttatgtttaaagaggcatttgaatgcatgagaaagctgagaatcaatctcaatctgatttatgatcataaccctaaggtgtttcttgraaatgtggaaaccttcattaaacagatagattctgtgaatcatattaacttgttttttacagaattgaaagaagaagatgtcacgaagaccatgtaccct

SEQ ID NO: 2504 - DNA, 201 bp, Homo sapiens
cttggaaaccctcaggcagtttgattgcatctacacaagataaacccaaccagcaggatattgtgttttttgagaaaaatggactccttcatggacacttyacacttcccttccttaaagatgaggttaaggtaaatgacttgctctggaatgcagattcctctgtgcttgcagtctggctggaagaccttcagagagaag

SEQ ID NO: 2505 - DNA, 201 bp, Homo sapiens
ggagctgactctgggtagccggctgcgcgtggctggggaggcgaggccggacgcacctctgtttgggggtcctcagagattaatgattcatcaagggatasttgtacttgtctcgtgggaatcacttcatcatgcgaaatctgaaattatttcggaccctggagttcagggatattcaaggtccagggaatcctcagtgct

SEQ ID NO: 2506 - DNA, 201 bp, Homo sapiens
tccatccttggaggcctagtgccgtcggagagagagcgggagccgcggacagagacgcgtgcgcaattcggagccgactctgggtgcggactgtgggagckgactctgggtagccggctgcgcgtggctggggaggcgaggccggacgcacctctgtttgggggtcctcagagattaatgattcatcaagggatagttgta

SEQ ID NO: 2507 - DNA, 201 bp, Homo sapiens
ttaactttaccaaagaccagctggtgggcctcggcagaactctggcaggaaagctggttgagcagaggaagcacattgatgcggccatggttttggaagastgtgcccaggattatgaagaagctgtgctcttgctgttagaaggagctgcctgggaagaagctttgaggctggtatacaaatataacagactggatatta

SEQ ID NO: 2508 - DNA, 201 bp, Homo sapiens
accaagctcacaacagtaccaggatatcagcattgcttatggggagcacctgatgcaggagcacatgtatgagccagcggggctcatgtttgcccgttgcrgtgcccacgagaaagctctctcagcctttctgacatgtggcaactggaagcaagccctctgtgtggcagcccagcttaactttaccaaagaccagctggt

SEQ ID NO: 2509 - DNA, 201 bp, Homo sapiens
gactctcagacagccacattcagtcgccacaagaaacgtttattggtagttcgagagctcaaggagcaagcccagcaggcaggtctggatgatgaggtacyccacgggcaagagtcagacctcttctctgaaactagcagtgtcgtgagtggcagtgagatgagtggcaaatactcccatagtaactccaggatatcagcg

SEQ ID NO: 2510 - DNA, 201 bp, Homo sapiens
aaaatagaccttgtctgcgatgctatgagagcagtcatggagagcataaatcctcataaatactgcctatccatacttacatctcatgtaaagaagacaamcccagaactggaaattgtactgcaaaaagtacacgagcttcaaggaaatgctccctctgatcctgatgctgtgagtgctgaagaggccttgaaatatttg

SEQ ID NO: 2511 - DNA, 201 bp, Homo sapiens
tggcaaatactcccatagtaactccaggatatcagcgagatcatccaagaatcgccgaaaagcggagcggaagaagcacagcctcaaagaaggcagtccgmtggaggacctggccctcctggaggcactgagtgaagtggtgcagaacactgaaaacctgaaagatgaagtataccatattttaaaggtactctttctctt

SEQ ID NO: 2512 - DNA, 201 bp, Homo sapiens
tcaccaagctcacaacagtaccaggatatcagcattgcttatggggagcacctgatgcaggagcacatgtatgagccagcggggctcatgtttgcccgttrcggtgcccacgagaaagctctctcagcctttctgacatgtggcaactggaagcaagccctctgtgtggcagcccagcttaactttaccaaagaccagctg

SEQ ID NO: 2513 - DNA, 201 bp, Homo sapiens
accctgcaccagttaccagcagtgtctacctgtccagggatcctgacgggaataaaatagaccttgtctgcgatgctatgagagcagtcatggagagcatraatcctcataaatactgcctatccatacttacatctcatgtaaagaagacaaccccagaactggaaattgtactgcaaaaagtacacgagcttcaaggaa

SEQ ID NO: 2514 - DNA, 201 bp, Homo sapiens
tggatggggtcataatcagtctatgttgcaattccaagaccaagtcagtagtattacagctggctgatggccagatatttaagtacctttgggagtcaccktctctggctattaaaccatggaagaactctggtggatttcctgttcggtttccttatccatgcacccagaccgaattggccatgattggagaagaggaat

SEQ ID NO: 2515 - DNA, 201 bp, Homo sapiens
aggggacggtgctcattggttcagaacatggcctgatagaagtagaccctgtctcaagagaagtgaaaaatgaagtttctttggtggcagaaggctttctyccagaggatggaagtggccgcattgttggtgttcaggacttgctggatcaggagtctgtgtgtgtggccacagcctctggagacgtcatactctgcagtc

SEQ ID NO: 2516 - DNA, 201 bp, Homo sapiens
ttttgcctgagggatgcttcatttaaaacattacaggccggcctgagcagcaatcatgtgtcccatggggaagttctgcggaaagtggagaggggttcacsgattgtcactgttgtgccccaggacacaaagcttgtattacagatgccaaggggaaacttagaagttgttcatcatcgagccctggttttagctcagatt

SEQ ID NO: 2517 - DNA, 201 bp, Homo sapiens
ttcagaacatggcctgatagaagtagaccctgtctcaagagaagtgaaaaatgaagtttctttggtggcagaaggctttctcccagaggatggaagtggcygcattgttggtgttcaggacttgctggatcaggagtctgtgtgtgtggccacagcctctggagacgtcatactctgcagtctcagcacacaacagctgga

SEQ ID NO: 2518 - DNA, 201 bp, Homo sapiens
aataatgaagatcaagatgtaaacccgctgaaactaggccttctcacttggattgaagaagacgtcttcctggctgtaagccacagtgagttcagcccccrgtctgtcattcaccatttgactgcagcttcttctgagatggatgaagagcatggacagctcaatgtcagttcatctgcagcggtggatggggtcataatc

SEQ ID NO: 2519 - DNA, 201 bp, Homo sapiens
ttatgagttggagtcctgaccaagagctggtgcttcttgccacaggtcaacagaccctgattatgatgacaaaagattttgagccaatcctggagcagcaratccatcaggatgattttggtgaaagcaagtttatcactgttggatggggtaggaaggagacacagttccatggatcagaaggcagacaagcagcttttc

SEQ ID NO: 2520 - DNA, 201 bp, Homo sapiens
aagtcacagaaggatcccaaagaatatcttccatttcttaatacacttaagaaaatggaaactaattatcagcggtttactatagacaaatacttgaaacratatgaaaaagccattggccacctcagcaaatgtggacctgagtacttcccagaatgcttaaacttgataaaagataaaaacttgtataacgaagctctg

SEQ ID NO: 2521 - DNA, 201 bp, Homo sapiens
catggacactttacacttcccttccttaaagatgaggttaaggtaaatgacttgctctggaatgcagattcctctgtgcttgcagtctggctggaagaccytcagagagaagaaagctccattccgaaaacctgtgttcagctctggactgttggaaactatcactggtatctcaagcaaagtttatccttcagcacctgt

SEQ ID NO: 2522 - DNA, 201 bp, Homo sapiens
agaccgaattggccatgattggagaagaggaatgtgtccttggtctgactgacaggtgtcgctttttcatcaatgacattgaggttgcgtcaaatatcacrtcatttgcagtatatgatgagtttttattgttgacaacccattcccatacctgccagtgtttttgcctgagggatgcttcatttaaaacattacaggccg

SEQ ID NO: 2523 - DNA, 201 bp, Homo sapiens
gagcatggacagctcaatgtcagttcatctgcagcggtggatggggtcataatcagtctatgttgcaattccaagaccaagtcagtagtattacagctggytgatggccagatatttaagtacctttgggagtcaccttctctggctattaaaccatggaagaactctggtggatttcctgttcggtttccttatccatgc

SEQ ID NO: 2524 - DNA, 201 bp, Homo sapiens
tcagtcgccacaagaaacgtttattggtagttcgagagctcaaggagcaagcccagcaggcaggtctggatgatgaggtaccccacgggcaagagtcagayctcttctctgaaactagcagtgtcgtgagtggcagtgagatgagtggcaaatactcccatagtaactccaggatatcagcgagatcatccaagaatcgcc

SEQ ID NO: 2525 - DNA, 201 bp, Homo sapiens; identical to SEQ ID NO: 2507

SEQ ID NO: 2526 - DNA, 201 bp, Homo sapiens; identical to SEQ ID NO: 2491

SEQ ID NO: 2527 - DNA, 201 bp, Homo sapiens
ttgctgcatctggtagatgttaatgaattatatgatcattctcttggcacctatgactttgatttggtcctcatggtagctgagaagtcacagaaggatcycaaagaatatcttccatttcttaatacacttaagaaaatggaaactaattatcagcggtttactatagacaaatacttgaaacgatatgaaaaagccatt

SEQ ID NO: 2528 - DNA, 201 bp, Homo sapiens
tggaaactatcactggtatctcaagcaaagtttatccttcagcacctgtgggaagagcaagattgtgtctctgatgtgggaccctgtgaccccataccggytgcatgttctctgtcagggctggcattacctcgcctatgattggcactggacgactgaccggagcgtgggagataattcaagtgacttgtccaatgtggc

SEQ ID NO: 2529 - DNA, 201 bp, Homo sapiens
gagattaatgtttcatgatttctacctccaaagtgtgaagacaagtaaaacaatgtttctaaattgtcttattttgttggcggagaagattacaatggctrttagtgctacatttggtcaaatgtaatcacttaaatagcttcttgtcaccttaaactaaagcagaataaaaagtatcctttgaaattataagccctcctt

SEQ ID NO: 2530 - DNA, 201 bp, Homo sapiens
agtaaaacaatgtttctaaattgtcttattttgttggcggagaagattacaatggctattagtgctacatttggtcaaatgtaatcacttaaatagcttcwtgtcaccttaaactaaagcagaataaaaagtatcctttgaaattataagccctcctttgctgacagctattattttgtaacatcttaccaggtcatgtgc

SEQ ID NO: 2531 - DNA, 201 bp, Homo sapiens
caaatgcctaaactacagcactgtacataaactaacaggaaatgctgcttttgatcctcaaagaagtgatatagccaaaattgtaatttaagaagcctttsccagtatagcaagatgttaactatagaatcaatctaggagtattcactgtaaaattcaacttttctgtatgtttgaacattttcacaatctcataggagt

SEQ ID NO: 2532 - DNA, 201 bp, Homo sapiens
aaatgcctaaactacagcactgtacataaactaacaggaaatgctgcttttgatcctcaaagaagtgatatagccaaaattgtaatttaagaagcctttgycagtatagcaagatgttaactatagaatcaatctaggagtattcactgtaaaattcaacttttctgtatgtttgaacattttcacaatctcataggagtt

SEQ ID NO: 2533 - DNA, 201 bp, Homo sapiens
aagcctttgccagtatagcaagatgttaactatagaatcaatctaggagtattcactgtaaaattcaacttttctgtatgtttgaacattttcacaatctmataggagtttttaaaaagaagagaaagaagatatactttgctttggagaaatctactttttgacttacatgggtttgctgtaattaagtgcccaatattg

SEQ ID NO: 2534 - DNA, 201 bp, Homo sapiens; identical to SEQ ID NO: 2487

SEQ ID NO: 2535 - DNA, 201 bp, Homo sapiens
cgcgtgcgcaattcggagccgactctgggtgcggactgtgggagctgactctgggtagccggctgcgcgtggctggggaggcgaggccggacgcacctctstttgggggtcctcagttgtacttgtctcgtgggaatcacttcatcatgcgaaatctgaaattatttcggaccctggagttcagggatattcaaggtccag

SEQ ID NO: 2536 - DNA, 201 bp, Homo sapiens; identical to SEQ ID NO: 2490

SEQ ID NO: 2537 - DNA, 201 bp, Homo sapiens; identical to SEQ ID NO: 2491

SEQ ID NO: 2538 - DNA, 201 bp, Homo sapiens
aagagtgtgcccaggattatgaagaagctgtgctcttgctgttagaaggagctgcctgggaagaagctttgaggctggtatacaaatataacagactggakattatagaaaccaacgtaaagccttccattttagaaggtgagggttccattttagatagaattcctcatttggaagaagcccagaaaaattatatggcat

SEQ ID NO: 2539 - DNA, 201 bp, Homo sapiens; identical to SEQ ID NO: 2493

SEQ ID NO: 2540 - DNA, 201 bp, Homo sapiens; identical to SEQ ID NO: 2494

SEQ ID NO: 2541 - DNA, 201 bp, Homo sapiens
tcggaagtggttggacaaagaagaagatgtcacgaagaccatgtaccctgcaccagttaccagcagtgtctacctgtccagggatcctgacgggaataaamtagaccttgtctgcgatgctatgagagcagtcatggagagcataaatcctcataaatactgcctatccatacttacatctcatgtaaagaagacaacccc

SEQ ID NO: 2542 - DNA, 201 bp, Homo sapiens; identical to SEQ ID NO: 2496

SEQ ID NO: 2543 - DNA, 201 bp, Homo sapiens; identical to SEQ ID NO: 2497

SEQ ID NO: 2544 - DNA, 201 bp, Homo sapiens; identical to SEQ ID NO: 2498

SEQ ID NO: 2545 - DNA, 201 bp, Homo sapiens; identical to SEQ ID NO: 2499

SEQ ID NO: 2546 - DNA, 201 bp, Homo sapiens; identical to SEQ ID NO: 2500

SEQ ID NO: 2547 - DNA, 201 bp, Homo sapiens; identical to SEQ ID NO: 2501

SEQ ID NO: 2548 - DNA, 201 bp, Homo sapiens; identical to SEQ ID NO: 2502

SEQ ID NO: 2549 - DNA, 201 bp, Homo sapiens; identical to SEQ ID NO: 2504

SEQ ID NO: 2550 - DNA, 201 bp, Homo sapiens
tccatccttggaggcctagtgccgtcggagagagagcgggagccgcggacagagacgcgtgcgcaattcggagccgactctgggtgcggactgtgggagckgactctgggtagccggctgcgcgtggctggggaggcgaggccggacgcacctctgtttgggggtcctcagttgtacttgtctcgtgggaatcacttcatc

SEQ ID NO: 2551 - DNA, 201 bp, Homo sapiens; identical to SEQ ID NO: 2507

SEQ ID NO: 2552 - DNA, 201 bp, Homo sapiens; identical to SEQ ID NO: 2508

SEQ ID NO: 2553 - DNA, 201 bp, Homo sapiens; identical to SEQ ID NO: 2509

SEQ ID NO: 2554 - DNA, 201 bp, Homo sapiens; identical to SEQ ID NO: 2510

SEQ ID NO: 2555 - DNA, 201 bp, Homo sapiens; identical to SEQ ID NO: 2511

SEQ ID NO: 2556 - DNA, 201 bp, Homo sapiens; identical to SEQ ID NO: 2512

SEQ ID NO: 2557 - DNA, 201 bp, Homo sapiens; identical to SEQ ID NO: 2513

SEQ ID NO: 2558 - DNA, 201 bp, Homo sapiens; identical to SEQ ID NO: 2514

SEQ ID NO: 2559 - DNA, 201 bp, Homo sapiens; identical to SEQ ID NO: 2515

SEQ ID NO: 2560 - DNA, 201 bp, Homo sapiens; identical to SEQ ID NO: 2516

SEQ ID NO: 2561 - DNA, 201 bp, Homo sapiens; identical to SEQ ID NO: 2517

SEQ ID NO: 2562 - DNA, 201 bp, Homo sapiens; identical to SEQ ID NO: 2518

SEQ ID NO: 2563 - DNA, 201 bp, Homo sapiens; identical to SEQ ID NO: 2519

SEQ ID NO: 2564 - DNA, 201 bp, Homo sapiens; identical to SEQ ID NO: 2520

SEQ ID NO: 2565 - DNA, 201 bp, Homo sapiens; identical to SEQ ID NO: 2521

SEQ ID NO: 2566 - DNA, 201 bp, Homo sapiens; identical to SEQ ID NO: 2522

SEQ ID NO: 2567 - DNA, 201 bp, Homo sapiens; identical to SEQ ID NO: 2523

SEQ ID NO: 2568 - DNA, 201 bp, Homo sapiens; identical to SEQ ID NO: 2524

SEQ ID NO: 2569 - DNA, 201 bp, Homo sapiens; identical to SEQ ID NO: 2507

SEQ ID NO: 2570 - DNA, 201 bp, Homo sapiens; identical to SEQ ID NO: 2491

SEQ ID NO: 2571 - DNA, 201 bp, Homo sapiens; identical to SEQ ID NO: 2527

SEQ ID NO: 2572 - DNA, 201 bp, Homo sapiens; identical to SEQ ID NO: 2528

SEQ ID NO: 2573 - DNA, 201 bp, Homo sapiens
agccgactctgggtgcggactgtgggagctgactctgggtagccggctgcgcgtggctggggaggcgaggccggacgcacctctgtttgggggtcctcagstgtacttgtctcgtgggaatcacttcatcatgcgaaatctgaaattatttcggaccctggagttcagggatattcaaggtccagggaatcctcagtgctt

SEQ ID NO: 2574 - DNA, 201 bp, Homo sapiens; identical to SEQ ID NO: 2529

SEQ ID NO: 2575 - DNA, 201 bp, Homo sapiens; identical to SEQ ID NO: 2530

SEQ ID NO: 2576 - DNA, 201 bp, Homo sapiens; identical to SEQ ID NO: 2531

SEQ ID NO: 2577 - DNA, 201 bp, Homo sapiens; identical to SEQ ID NO: 2532

SEQ ID NO: 2578 - DNA, 201 bp, Homo sapiens; identical to SEQ ID NO: 2533

SEQ ID NO: 2579 - DNA, 201 bp, Homo sapiens; identical to SEQ ID NO: 2487

SEQ ID NO: 2580 - DNA, 201 bp, Homo sapiens; identical to SEQ ID NO: 2488

SEQ ID NO: 2581 - DNA, 201 bp, Homo sapiens; identical to SEQ ID NO: 2489

SEQ ID NO: 2582 - DNA, 201 bp, Homo sapiens; identical to SEQ ID NO: 2490

SEQ ID NO: 2583 - DNA, 201 bp, Homo sapiens; identical to SEQ ID NO: 2491

SEQ ID NO: 2584 - DNA, 201 bp, Homo sapiens
tgggcctcggcagaactctggcagaagctgtgctcttgctgttagaaggagctgcctgggaagaagctttgaggctggtatacaaatataacagactggakattatagaaaccaacgtaaagccttccattttagaagcccagaaaaattatatggcatttctggactctcagacagccacattcagtcgccacaagaaac

SEQ ID NO: 2585 - DNA, 201 bp, Homo sapiens; identical to SEQ ID NO: 2494

SEQ ID NO: 2586 - DNA, 201 bp, Homo sapiens; identical to SEQ ID NO: 2495

SEQ ID NO: 2587 - DNA, 201 bp, Homo sapiens; identical to SEQ ID NO: 2496

SEQ ID NO: 2588 - DNA, 201 bp, Homo sapiens; identical to SEQ ID NO: 2497

SEQ ID NO: 2589 - DNA, 201 bp, Homo sapiens; identical to SEQ ID NO: 2498

SEQ ID NO: 2590 - DNA, 201 bp, Homo sapiens
ttgcttatggggagcacctgatgcaggagcacatgtatgagccagcggggctcatgtttgcccgttgcggtgcccacgagaaagctctctcagcctttctsacatgtggcaactggaagcaagccctctgtgtggcagcccagcttaactttaccaaagaccagctggtgggcctcggcagaactctggcagaagctgtgc

SEQ ID NO: 2591 - DNA, 201 bp, Homo sapiens; identical to SEQ ID NO: 2500

SEQ ID NO: 2592 - DNA, 201 bp, Homo sapiens; identical to SEQ ID NO: 2501

SEQ ID NO: 2593 - DNA, 201 bp, Homo sapiens; identical to SEQ ID NO: 2502

SEQ ID NO: 2594 - DNA, 201 bp, Homo sapiens; identical to SEQ ID NO: 2503

SEQ ID NO: 2595 - DNA, 201 bp, Homo sapiens; identical to SEQ ID NO: 2504

SEQ ID NO: 2596 - DNA, 201 bp, Homo sapiens; identical to SEQ ID NO: 2505

SEQ ID NO: 2597 - DNA, 201 bp, Homo sapiens; identical to SEQ ID NO: 2506

SEQ ID NO: 2598 - DNA, 201 bp, Homo sapiens; identical to SEQ ID NO: 2508

SEQ ID NO: 2599 - DNA, 201 bp, Homo sapiens; identical to SEQ ID NO: 2509

SEQ ID NO: 2600 - DNA, 201 bp, Homo sapiens; identical to SEQ ID NO: 2510

SEQ ID NO: 2601 - DNA, 201 bp, Homo sapiens; identical to SEQ ID NO: 2511

SEQ ID NO: 2602 - DNA, 201 bp, Homo sapiens; identical to SEQ ID NO: 2512

SEQ ID NO: 2603 - DNA, 201 bp, Homo sapiens; identical to SEQ ID NO: 2513

SEQ ID NO: 2604 - DNA, 201 bp, Homo sapiens; identical to SEQ ID NO: 2514

SEQ ID NO: 2605 - DNA, 201 bp, Homo sapiens; identical to SEQ ID NO: 2515

SEQ ID NO: 2606 - DNA, 201 bp, Homo sapiens; identical to SEQ ID NO: 2516

SEQ ID NO: 2607 - DNA, 201 bp, Homo sapiens; identical to SEQ ID NO: 2517

SEQ ID NO: 2608 - DNA, 201 bp, Homo sapiens; identical to SEQ ID NO: 2518

SEQ ID NO: 2609 - DNA, 201 bp, Homo sapiens; identical to SEQ ID NO: 2519

SEQ ID NO: 2610 - DNA, 201 bp, Homo sapiens; identical to SEQ ID NO: 2520

SEQ ID NO: 2611 - DNA, 201 bp, Homo sapiens; identical to SEQ ID NO: 2521

SEQ ID NO: 2612 - DNA, 201 bp, Homo sapiens; identical to SEQ ID NO: 2522

SEQ ID NO: 2613 - DNA, 201 bp, Homo sapiens; identical to SEQ ID NO: 2523

SEQ ID NO: 2614 - DNA, 201 bp, Homo sapiens; identical to SEQ ID NO: 2524

SEQ ID NO: 2615 - DNA, 201 bp, Homo sapiens; identical to SEQ ID NO: 2491

SEQ ID NO: 2616 - DNA, 201 bp, Homo sapiens; identical to SEQ ID NO: 2527

SEQ ID NO: 2617 - DNA, 201 bp, Homo sapiens; identical to SEQ ID NO: 2528

SEQ ID NO: 2618 - DNA, 201 bp, Homo sapiens; identical to SEQ ID NO: 2529

SEQ ID NO: 2619 - DNA, 201 bp, Homo sapiens; identical to SEQ ID NO: 2530

SEQ ID NO: 2620 - DNA, 201 bp, Homo sapiens; identical to SEQ ID NO: 2531

SEQ ID NO: 2621 - DNA, 201 bp, Homo sapiens; identical to SEQ ID NO: 2532

SEQ ID NO: 2622 - DNA, 201 bp, Homo sapiens; identical to SEQ ID NO: 2533

SEQ ID NO: 2623 - DNA, 201 bp, Homo sapiens; identical to SEQ ID NO: 2487

SEQ ID NO: 2624 - DNA, 201 bp, Homo sapiens; identical to SEQ ID NO: 2535

SEQ ID NO: 2625 - DNA, 201 bp, Homo sapiens; identical to SEQ ID NO: 2490

SEQ ID NO: 2626 - DNA, 201 bp, Homo sapiens; identical to SEQ ID NO: 2491

SEQ ID NO: 2627 - DNA, 201 bp, Homo sapiens; identical to SEQ ID NO: 2492

SEQ ID NO: 2628 - DNA, 201 bp, Homo sapiens; identical to SEQ ID NO: 2493

SEQ ID NO: 2629 - DNA, 201 bp, Homo sapiens; identical to SEQ ID NO: 2494

SEQ ID NO: 2630 - DNA, 201 bp, Homo sapiens; identical to SEQ ID NO: 2495

SEQ ID NO: 2631 - DNA, 201 bp, Homo sapiens; identical to SEQ ID NO: 2496

SEQ ID NO: 2632 - DNA, 201 bp, Homo sapiens; identical to SEQ ID NO: 2497

SEQ ID NO: 2633 - DNA, 201 bp, Homo sapiens; identical to SEQ ID NO: 2498

SEQ ID NO: 2634 - DNA, 201 bp, Homo sapiens; identical to SEQ ID NO: 2499

SEQ ID NO: 2635 - DNA, 201 bp, Homo sapiens; identical to SEQ ID NO: 2500

SEQ ID NO: 2636 - DNA, 201 bp, Homo sapiens; identical to SEQ ID NO: 2501

SEQ ID NO: 2637 - DNA, 201 bp, Homo sapiens; identical to SEQ ID NO: 2502

SEQ ID NO: 2638 - DNA, 201 bp, Homo sapiens; identical to SEQ ID NO: 2503

SEQ ID NO: 2639 - DNA, 201 bp, Homo sapiens; identical to SEQ ID NO: 2504

SEQ ID NO: 2640 - DNA, 201 bp, Homo sapiens; identical to SEQ ID NO: 2550

SEQ ID NO: 2641 - DNA, 201 bp, Homo sapiens; identical to SEQ ID NO: 2507

SEQ ID NO: 2642 - DNA, 201 bp, Homo sapiens; identical to SEQ ID NO: 2508

SEQ ID NO: 2643 - DNA, 201 bp, Homo sapiens; identical to SEQ ID NO: 2509

SEQ ID NO: 2644 - DNA, 201 bp, Homo sapiens; identical to SEQ ID NO: 2510

SEQ ID NO: 2645 - DNA, 201 bp, Homo sapiens; identical to SEQ ID NO: 2511

SEQ ID NO: 2646 - DNA, 201 bp, Homo sapiens; identical to SEQ ID NO: 2512

SEQ ID NO: 2647 - DNA, 201 bp, Homo sapiens; identical to SEQ ID NO: 2513

SEQ ID NO: 2648 - DNA, 201 bp, Homo sapiens; identical to SEQ ID NO: 2514

SEQ ID NO: 2649 - DNA, 201 bp, Homo sapiens; identical to SEQ ID NO: 2515

SEQ ID NO: 2650 - DNA, 201 bp, Homo sapiens; identical to SEQ ID NO: 2516

SEQ ID NO: 2651 - DNA, 201 bp, Homo sapiens; identical to SEQ ID NO: 2517

SEQ ID NO: 2652 - DNA, 201 bp, Homo sapiens; identical to SEQ ID NO: 2518

SEQ ID NO: 2653 - DNA, 201 bp, Homo sapiens; identical to SEQ ID NO: 2519

SEQ ID NO: 2654 - DNA, 201 bp, Homo sapiens; identical to SEQ ID NO: 2520

SEQ ID NO: 2655 - DNA, 201 bp, Homo sapiens; identical to SEQ ID NO: 2521

SEQ ID NO: 2656 - DNA, 201 bp, Homo sapiens; identical to SEQ ID NO: 2522

SEQ ID NO: 2657 - DNA, 201 bp, Homo sapiens; identical to SEQ ID NO: 2523

SEQ ID NO: 2658 - DNA, 201 bp, Homo sapiens; identical to SEQ ID NO: 2524

SEQ ID NO: 2659 - DNA, 201 bp, Homo sapiens; identical to SEQ ID NO: 2507

SEQ ID NO: 2660 - DNA, 201 bp, Homo sapiens; identical to SEQ ID NO: 2491

SEQ ID NO: 2661 - DNA, 201 bp, Homo sapiens; identical to SEQ ID NO: 2527

SEQ ID NO: 2662 - DNA, 201 bp, Homo sapiens; identical to SEQ ID NO: 2528

SEQ ID NO: 2663 - DNA, 201 bp, Homo sapiens; identical to SEQ ID NO: 2573

SEQ ID NO: 2664 - DNA, 201 bp, Homo sapiens; identical to SEQ ID NO: 2529

SEQ ID NO: 2665 - DNA, 201 bp, Homo sapiens; identical to SEQ ID NO: 2530

SEQ ID NO: 2666 - DNA, 201 bp, Homo sapiens; identical to SEQ ID NO: 2531

SEQ ID NO: 2667 - DNA, 201 bp, Homo sapiens; identical to SEQ ID NO: 2532

SEQ ID NO: 2668 - DNA, 201 bp, Homo sapiens; identical to SEQ ID NO: 2533

SEQ ID NO: 2669 - DNA, 201 bp, Homo sapiens; identical to SEQ ID NO: 2487

SEQ ID NO: 2670 - DNA, 201 bp, Homo sapiens; identical to SEQ ID NO: 2535

SEQ ID NO: 2671 - DNA, 201 bp, Homo sapiens; identical to SEQ ID NO: 2490

SEQ ID NO: 2672 - DNA, 201 bp, Homo sapiens; identical to SEQ ID NO: 2491

SEQ ID NO: 2673 - DNA, 201 bp, Homo sapiens; identical to SEQ ID NO: 2496

SEQ ID NO: 2674 - DNA, 201 bp, Homo sapiens; identical to SEQ ID NO: 2497

SEQ ID NO: 2675 - DNA, 201 bp, Homo sapiens; identical to SEQ ID NO: 2498

SEQ ID NO: 2676 - DNA, 201 bp, Homo sapiens; identical to SEQ ID NO: 2500

SEQ ID NO: 2677 - DNA, 201 bp, Homo sapiens; identical to SEQ ID NO: 2501

SEQ ID NO: 2678 - DNA, 201 bp, Homo sapiens
tggttggacaaacttatgtttaaagaggcatttgaatgcatgagaaagctgagaatcaatctcaatctgatttatgatcataaccctaaggtgtttcttgraaatgtggaaaccttcattaaacagatagattctgtgaatcatattaacttgttttttacagaattgaagtaaaagatgtcacgaagaccatgtaccctg

SEQ ID NO: 2679 - DNA, 201 bp, Homo sapiens; identical to SEQ ID NO: 2504

SEQ ID NO: 2680 - DNA, 201 bp, Homo sapiens; identical to SEQ ID NO: 2550

SEQ ID NO: 2681 - DNA, 201 bp, Homo sapiens; identical to SEQ ID NO: 2514

SEQ ID NO: 2682 - DNA, 201 bp, Homo sapiens; identical to SEQ ID NO: 2515

SEQ ID NO: 2683 - DNA, 201 bp, Homo sapiens; identical to SEQ ID NO: 2516

SEQ ID NO: 2684 - DNA, 201 bp, Homo sapiens; identical to SEQ ID NO: 2517

SEQ ID NO: 2685 - DNA, 201 bp, Homo sapiens; identical to SEQ ID NO: 2518

SEQ ID NO: 2686 - DNA, 201 bp, Homo sapiens; identical to SEQ ID NO: 2519

SEQ ID NO: 2687 - DNA, 201 bp, Homo sapiens; identical to SEQ ID NO: 2521

SEQ ID NO: 2688 - DNA, 201 bp, Homo sapiens; identical to SEQ ID NO: 2522

SEQ ID NO: 2689 - DNA, 201 bp, Homo sapiens; identical to SEQ ID NO: 2523

SEQ ID NO: 2690 - DNA, 201 bp, Homo sapiens; identical to SEQ ID NO: 2491

SEQ ID NO: 2691 - DNA, 201 bp, Homo sapiens; identical to SEQ ID NO: 2528

SEQ ID NO: 2692 - DNA, 201 bp, Homo sapiens; identical to SEQ ID NO: 2573

SEQ ID NO: 2693 - DNA, 201 bp, Homo sapiens
tgttttttacagaattgaagtaaaagatgtcacgaagaccatgtaccctgcaccagttaccagcagtgtctacctgtccagggatcctgacgggaataaamtagaccttgtctgcgatgctatgagagcagtcatggagagcataaatcctcataaatactgcctatccatacttacatctcatgtaaagaagacaacccc

SEQ ID NO: 2694 - DNA, 201 bp, Homo sapiens; identical to SEQ ID NO: 2513

SEQ ID NO: 2695 - DNA, 201 bp, Homo sapiens; identical to SEQ ID NO: 2510

SEQ ID NO: 2696 - DNA, 201 bp, Homo sapiens; identical to SEQ ID NO: 2494

SEQ ID NO: 2697 - DNA, 201 bp, Homo sapiens; identical to SEQ ID NO: 2527

SEQ ID NO: 2698 - DNA, 201 bp, Homo sapiens; identical to SEQ ID NO: 2502

SEQ ID NO: 2699 - DNA, 201 bp, Homo sapiens; identical to SEQ ID NO: 2508

SEQ ID NO: 2700 - DNA, 201 bp, Homo sapiens; identical to SEQ ID NO: 2499

SEQ ID NO: 2701 - DNA, 201 bp, Homo sapiens; identical to SEQ ID NO: 2507

SEQ ID NO: 2702 - DNA, 201 bp, Homo sapiens; identical to SEQ ID NO: 2493

SEQ ID NO: 2703 - DNA, 201 bp, Homo sapiens; identical to SEQ ID NO: 2492

SEQ ID NO: 2704 - DNA, 201 bp, Homo sapiens; identical to SEQ ID NO: 2509

SEQ ID NO: 2705 - DNA, 201 bp, Homo sapiens; identical to SEQ ID NO: 2524

SEQ ID NO: 2706 - DNA, 201 bp, Homo sapiens; identical to SEQ ID NO: 2511

SEQ ID NO: 2707 - DNA, 201 bp, Homo sapiens
cttctataatgtgcctaccaaaaagcctagtcctagcccatctgcctcaactcctctcccttttaggttgtagggaagaggccggagtgtagagtatattrtatcttctgtcccccttatgccaacaagatggccttcccctctgaaacaaagtaaaactgcaacactgtgacttcttaaatgagggatatgtgaaaaggc

SEQ ID NO: 2708 - DNA, 139 bp, Homo sapiens
gtgaatttatagtttaagagtgatttacactgaatttcaaataaaaggactataaaacgtgttatttttctgtaagggctataacatacatgtcaatatcmctgtttttaaataaaatatacttttatacagaagaaat

SEQ ID NO: 2709 - DNA, 105 bp, Homo sapiens
tttcaaataaaaggactataaaacgtgttatttttctgtaagggctataacatacatgtcaatatcactgtttttaaataaaatatacttttatacagaaraaat

SEQ ID NO: 2710 - DNA, 201 bp, Homo sapiens; identical to SEQ ID NO: 2707

SEQ ID NO: 2711 - DNA, 139 bp, Homo sapiens; identical to SEQ ID NO: 2708

SEQ ID NO: 2712 - DNA, 105 bp, Homo sapiens; identical to SEQ ID NO: 2709

SEQ ID NO: 2713 - DNA, 201 bp, Homo sapiens
ctgaaagtactgggattacaagcataagccaccgggcatggccccaattctgagcattaatttatttattgggtatgagctacagttccgattaggcccarctttacagggaaaagcagttaccgtgtatacaaattacccatttcctggagaaacatttaatagagaaaaattccgttctctggattgggaaaatccaac

SEQ ID NO: 2714 - DNA, 201 bp, Homo sapiens
tcagcccttaaatatgcaggtcttcaaggtttaatgtctgtattggcagaaataagaccaaagaatgacttggggcatcctttttgtaataatttgagatstggagattggatgattgactatgtcagtaaccggcttatttcacgatcaggaactattgctgaagttggtaaatggttgcaggctatgttcttctacctg

SEQ ID NO: 2715 - DNA, 201 bp, Homo sapiens
tttcagtattatttccttcaaggaaatgagaaaagtggtggaggttacatagttgtggaccccattttacgtgttggtgctgataatcatgtgctaccctwggactgtgttactcttcagacatttttagctaagtgtttgggaccttttgatgaatgggaaagcagacttagggttgcaaaagaatcaggctacaacatg

SEQ ID NO: 2716 - DNA, 201 bp, Homo sapiens
aggaatgctggtccccagatagatcgaaacatgaaggacgaaggttttaatataactgcaggagttgatgaagaaacaggatttgtttatggaggaaatcrtttcaattgtggcacatggatggataaaatgggagaaagtgacagagctagaaacagaggaatcccagccacaccaagagatgggtctgctgtggaaatt

SEQ ID NO: 2717 - DNA, 201 bp, Homo sapiens
gatttcagtggtttctgaagaacggttttacactaagtggaatcctgaagcattgccttcaaacacaggtgaagttaatttccaaagcggcattattgcakccaggtgtgctatcagtaaacttcatcaggagcttggagccaagggttttattcaggtgtatgtggatcaagttgatgaagacatagtggcagtaacaag

SEQ ID NO: 2718 - DNA, 184 bp, Homo sapiens
gggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagaaactgggtctcactatgttgcccaggttgatat

SEQ ID NO: 2719 - DNA, 201 bp, Homo sapiens
gcctattgggtattttcttcgtgcaaaattatatttttccagattgatgggcccggagactactgcaaagactatagttttggttaaaaatgttctttccsgacattatgttcatcttgagagatccccttggaaaggacttccagaactgaccaatgagaatgcccagtactgtcctttcagctgtgaaacacaagcctg

SEQ ID NO: 2720 - DNA, 201 bp, Homo sapiens
ttgcactaacgactttcataccacatgacaaggggccagcagcaattgaagaatgctgtaattggtttcataaaagaatggaggaattaaattcagagaakcatcgactcattaactatcatcaggaacaggcagttaattgccttttgggaaatgtgttttatgaacgactggctggccatggtccaaaactaggacctg

SEQ ID NO: 2721 - DNA, 201 bp, Homo sapiens
gcccaactttacagggaaaagcagttaccgtgtatacaaattacccatttcctggagaaacatttaatagagaaaaattccgttctctggattgggaaaayccaacagaaagagaagatgattctgataaatactgtaaacttaatctgcaacaatctggttcatttcagtattatttccttcaaggaaatgagaaaagtg

SEQ ID NO: 2722 - DNA, 201 bp, Homo sapiens
cccttccctgccaattctttcacctgccctaatggatgtaccttataggttaaatgagatcacaaaagaaaaggagcaatgttgtgtttctctagctgcasgcttacctcatttttcttctggtattttccgctgctggggaagggatacttttattgcacttagaggtatactgctgattactggacgctatgtagaagc

SEQ ID NO: 2723 - DNA, 201 bp, Homo sapiens
aatacaaagaaaagggaatacctgctttgattgaaaatgatcaccatatgaattccatccgaaaaataatttgggaggatatttttccaaagcttaaactytgggaatttttccaagtagatgtcaacaaagcggttgagcaatttagaagacttcttacacaagaaaataggcgagtaaccaagtctgatccaaaccaac

SEQ ID NO: 2724 - DNA, 201 bp, Homo sapiens
gaaaactttagatccagatgatatggtttactgtggaatttatgacaatgcattagacaatgacaactacaatcttgctaaaggtttcaattatcaccaasgacctgagtggctgtggcctattgggtattttcttcgtgcaaaattatatttttccagattgatgggcccggagactactgcaaagactatagttttggt

SEQ ID NO: 2725 - DNA, 201 bp, Homo sapiens
tggctgagctaaatcagatcctttaccgatgtgaatcagaagaaaaggaagatggtggagggtgctatgacataccaaactggtcagcccttaaatatgcmggtcttcaaggtttaatgtctgtattggcagaaataagaccaaagaatgacttggggcatcctttttgtaataatttgagatctggagattggatgattg

SEQ ID NO: 2726 - DNA, 159 bp, Homo sapiens
gggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagaaactgggt

SEQ ID NO: 2727 - DNA, 201 bp, Homo sapiens
ttcaacctttgtgaaacacctttcattgggttcagttcaactgtgtggagtaggaaaattcccttccctgccaattctttcacctgccctaatggatgtaycttataggttaaatgagatcacaaaagaaaaggagcaatgttgtgtttctctagctgcaggcttacctcatttttcttctggtattttccgctgctgggg

SEQ ID NO: 2728 - DNA, 201 bp, Homo sapiens
cacactggatcagccattgtttgaagtcatacaggaagcaatgcaaaaacacatgcagggcatacagttccgagaaaggaatgctggtccccagatagatygaaacatgaaggacgaaggttttaatataactgcaggagttgatgaagaaacaggatttgtttatggaggaaatcgtttcaattgtggcacatggatgga

SEQ ID NO: 2729 - DNA, 201 bp, Homo sapiens
caggcagttaattgccttttgggaaatgtgttttatgaacgactggctggccatggtccaaaactaggacctgtcactagaaagcatcctttagttaccargtattttactttcccatttgaagagatagacttctccatggaagaatctatgattcatctgccaaataaagcttgttttctgatggcacacaatggatgg

SEQ ID NO: 2730 - DNA, 201 bp, Homo sapiens
gatgttggacagctagtggaaaaattaaaaaaggaatggaatgttatttgtattactgatgttgtctacaatcatactgctgctaatagtaaatggatccrggaacatccagaatgtgcctataatcttgtgaattctccacacttaaaacctgcctgggtcttagacagagcactttggcgtttctcctgtgatgttgca

SEQ ID NO: 2731 - DNA, 201 bp, Homo sapiens
tgtttctctagctgcaggcttacctcatttttcttctggtattttccgctgctggggaagggatacttttattgcacttagaggtatactgctgattactrgacgctatgtagaagccaggaatattattttagcatttgcgggtaccctgaggcatggtctcattcctaatctactgggtgaaggaatttatgccagata

SEQ ID NO: 2732 - DNA, 201 bp, Homo sapiens
gacgctatgtagaagccaggaatattattttagcatttgcgggtaccctgaggcatggtctcattcctaatctactgggtgaaggaatttatgccagatasaattgtcgggatgctgtgtggtggtggctgcagtgtatccaggattactgtaaaatggttccaaatggtctagacattctcaagtgcccagtttccagaa

SEQ ID NO: 2733 - DNA, 201 bp, Homo sapiens
cattctcaagtgcccagtttccagaatgtatcctacagatgattctgctcctttgcctgctggcacactggatcagccattgtttgaagtcatacaggaarcaatgcaaaaacacatgcagggcatacagttccgagaaaggaatgctggtccccagatagatcgaaacatgaaggacgaaggttttaatataactgcagg

SEQ ID NO: 2734 - DNA, 201 bp, Homo sapiens
ctgctgattactggacgctatgtagaagccaggaatattattttagcatttgcgggtaccctgaggcatggtctcattcctaatctactgggtgaaggaawttatgccagatacaattgtcgggatgctgtgtggtggtggctgcagtgtatccaggattactgtaaaatggttccaaatggtctagacattctcaagtgc

SEQ ID NO: 2735 - DNA, 201 bp, Homo sapiens
ctaacgactttcataccacatgacaaggggccagcagcaattgaagaatgctgtaattggtttcataaaagaatggaggaattaaattcagagaagcatcractcattaactatcatcaggaacaggcagttaattgccttttgggaaatgtgttttatgaacgactggctggccatggtccaaaactaggacctgtcact

SEQ ID NO: 2736 - DNA, 201 bp, Homo sapiens
gaggaaatcgtttcaattgtggcacatggatggataaaatgggagaaagtgacagagctagaaacagaggaatcccagccacaccaagagatgggtctgcygtggaaattgtgggcctgagtaaatctgctgttcgctggttgctggaattatccaaaaaaaatattttcccttatcatgaagtcacagtaaaaagacatg

SEQ ID NO: 2737 - DNA, 201 bp, Homo sapiens
aataaaccagaggactgtccttatctctgggcacacatgaaaaaatacactgaaataactgcaacttatttccagggagtacgtcttgataactgccactsaacacctcttcacgtagctgagtacatgttggatgctgctaggaatttgcaacccaatttatatgtagtagctgaactgttcacaggaagtgaagatctg

SEQ ID NO: 2738 - DNA, 201 bp, Homo sapiens
tacagatgattctgctcctttgcctgctggcacactggatcagccattgtttgaagtcatacaggaagcaatgcaaaaacacatgcagggcatacagttcygagaaaggaatgctggtccccagatagatcgaaacatgaaggacgaaggttttaatataactgcaggagttgatgaagaaacaggatttgtttatggagg

SEQ ID NO: 2739 - DNA, 201 bp, Homo sapiens
atatattcaagaaatagaatttgaaaacttgtctccaggaagtgttattatattcagagttagtcttgatccacatgcacaagtcgctgttggaattcttygaaatcatctgacacaattcagtcctcactttaaatctggcagcctagctgttgacaatgcagatcctatattaaaaattccttttgcttctcttgcctc

SEQ ID NO: 2740 - DNA, 201 bp, Homo sapiens
gtttctatggcatgttgtgctagtggaagtacaagaggctatgatgaattagtgcctcatcagatttcagtggtttctgaagaacggttttacactaagtygaatcctgaagcattgccttcaaacacaggtgaagttaatttccaaagcggcattattgcagccaggtgtgctatcagtaaacttcatcaggagcttgga

SEQ ID NO: 2741 - DNA, 201 bp, Homo sapiens
tagttatggagcttcaagtccttggtgtgactatcagctcaggcctaattttaccatagcaatggttgtggcccctgagctctttactacagaaaaagcakggaaagctttggagattgcagaaaaaaaattgcttggtccccttggcatgaaaactttagatccagatgatatggtttactgtggaatttatgacaatgc

SEQ ID NO: 2742 - DNA, 201 bp, Homo sapiens
ctcactatgttgcccaggttgatattgaactcctggactcaagcaaccctccctctttggcctctgaaagtactgggattacaagcataagccaccgggcrtggccccaattctgagcattaatttatttattgggtatgagctacagttccgattaggcccaactttacagggaaaagcagttaccgtgtatacaaatta

SEQ ID NO: 2743 - DNA, 201 bp, Homo sapiens
tagatttcaatttgaatcagaaagaaatatcattaccaatgaaatgtgtttgagttcagtaagaattattcaaatgcctagaaatccatagtttggaaaakaaaaatcatgtcatcttctatttgtacagaaatgaaaataaaatatgaaaataatgaaagaaatgaaaagatagcttttaattgtggtatatataatctt

SEQ ID NO: 2744 - DNA, 201 bp, Homo sapiens
aagcattaggaaatttatttcctaaaaacagttttgtaaaattagtattgagttctattgagtattataagatagcttacattttcaaaatggaaattgtyggtcatatttctagaactttaaagaaaaaagaatgttatattagttttctaaaactcaactatctttagtcatgttcaaaaatctattgctagatcatag

SEQ ID NO: 2745 - DNA, 201 bp, Homo sapiens
cttaaattcaataaaatcactggaagtttttcatgataacttattttaagatgccttaaaaatcttaaagtcacaaaaggaaaaaggtttttaacatttayatgagttaacattttttcatagaacttatttcctagatagaattttttactgttttttactgttttcttaagaaaacagttaaatcattatgcattcagt

SEQ ID NO: 2746 - DNA, 201 bp, Homo sapiens
tcagttggaagaaagtagtggcaagaattctttcattgctatataatattcagtggctcatttatacctaataaaataatggtattttaaaataatgctaytttcaaagtagcatttttttagttagtttacaggttacatacccaaaaccttaactatgactaagaaattaaagaagaaaaccagcaaactaaaacttct

SEQ ID NO: 2747 - DNA, 201 bp, Homo sapiens
aaaataatggtattttaaaataatgctactttcaaagtagcatttttttagttagtttacaggttacatacccaaaaccttaactatgactaagaaattamagaagaaaaccagcaaactaaaacttctgggcagcaaaaatatataaatgcttcagatgtcaaatacccatgcttgaaagctcgtgtaatttactttaag

SEQ ID NO: 2748 - DNA, 201 bp, Homo sapiens
agttttaactagcttagttttctggtttccaaaactaaaatagattaaatcctacaaatttaaggacagttgtgacagtaatctgaccactatctataaayacattggacattggtttccaaatctccctttcttcttcagttccttccttgttcaatatatacccttctctaaactgtgcgggtaaaaggaatgactgtc

SEQ ID NO: 2749 - DNA, 201 bp, Homo sapiens
atattttaaagtttaagaaggcatgttaaacattatttcctctatggtagttaaaatacagaattagatttttaacaggtgtcatttgactaaacgtttcrgtagaatgcttcatacttgagtgatgctggataaggtattgtatttcaacaatggactatgccttggtttttcactaatcaaaatcaaaattactcttta

SEQ ID NO: 2750 - DNA, 162 bp, Homo sapiens
caaagataattgggaaaacatgagactggtcatattgatgaatattgtaacatgtgaattgtgatccatttctgatatgtcttgaactactgtgtctagtrggcaaatgtcattgttacctctgtgtgttaagaaaataaaaatattttctaaaggtctgta

SEQ ID NO: 2751 - DNA, 113 bp, Homo sapiens
acatgtgaattgtgatccatttctgatatgtcttgaactactgtgtctagtgggcaaatgtcattgttacctctgtgtgttaagaaaataaaaatattttytaaaggtctgta

SEQ ID NO: 2752 - DNA, 201 bp, Homo sapiens
cattaggtttgcggagttattttaaacataattgaaaaatcaaggttttttaatactttaaataaaacatctgtttttcaatgtggtaatttaagtcctaygatgagtttattaacatgtgctttttatttagggtatgagctacagttccgattaggcccaactttacagggaaaagcagttaccgtgtatacaaattac

SEQ ID NO: 2753 - DNA, 201 bp, Homo sapiens
taaaacatctgtttttcaatgtggtaatttaagtcctacgatgagtttattaacatgtgctttttatttagggtatgagctacagttccgattaggcccarctttacagggaaaagcagttaccgtgtatacaaattacccatttcctggagaaacatttaatagagaaaaattccgttctctggattgggaaaatccaac

SEQ ID NO: 2754 - DNA, 201 bp, Homo sapiens; identical to SEQ ID NO: 2714

SEQ ID NO: 2755 - DNA, 201 bp, Homo sapiens; identical to SEQ ID NO: 2715

SEQ ID NO: 2756 - DNA, 201 bp, Homo sapiens; identical to SEQ ID NO: 2716

SEQ ID NO: 2757 - DNA, 201 bp, Homo sapiens; identical to SEQ ID NO: 2717

SEQ ID NO: 2758 - DNA, 201 bp, Homo sapiens; identical to SEQ ID NO: 2719

SEQ ID NO: 2759 - DNA, 201 bp, Homo sapiens; identical to SEQ ID NO: 2720

SEQ ID NO: 2760 - DNA, 201 bp, Homo sapiens; identical to SEQ ID NO: 2721

SEQ ID NO: 2761 - DNA, 201 bp, Homo sapiens; identical to SEQ ID NO: 2722

SEQ ID NO: 2762 - DNA, 201 bp, Homo sapiens; identical to SEQ ID NO: 2723

SEQ ID NO: 2763 - DNA, 201 bp, Homo sapiens; identical to SEQ ID NO: 2724

SEQ ID NO: 2764 - DNA, 201 bp, Homo sapiens; identical to SEQ ID NO: 2725

SEQ ID NO: 2765 - DNA, 201 bp, Homo sapiens; identical to SEQ ID NO: 2727

SEQ ID NO: 2766 - DNA, 201 bp, Homo sapiens; identical to SEQ ID NO: 2728

SEQ ID NO: 2767 - DNA, 201 bp, Homo sapiens; identical to SEQ ID NO: 2729

SEQ ID NO: 2768 - DNA, 201 bp, Homo sapiens; identical to SEQ ID NO: 2730

SEQ ID NO: 2769 - DNA, 201 bp, Homo sapiens; identical to SEQ ID NO: 2731

SEQ ID NO: 2770 - DNA, 201 bp, Homo sapiens; identical to SEQ ID NO: 2732

SEQ ID NO: 2771 - DNA, 201 bp, Homo sapiens; identical to SEQ ID NO: 2733

SEQ ID NO: 2772 - DNA, 201 bp, Homo sapiens; identical to SEQ ID NO: 2734

SEQ ID NO: 2773 - DNA, 201 bp, Homo sapiens; identical to SEQ ID NO: 2735

SEQ ID NO: 2774 - DNA, 201 bp, Homo sapiens; identical to SEQ ID NO: 2736

SEQ ID NO: 2775 - DNA, 201 bp, Homo sapiens; identical to SEQ ID NO: 2737

SEQ ID NO: 2776 - DNA, 201 bp, Homo sapiens; identical to SEQ ID NO: 2738

SEQ ID NO: 2777 - DNA, 201 bp, Homo sapiens; identical to SEQ ID NO: 2739

SEQ ID NO: 2778 - DNA, 201 bp, Homo sapiens; identical to SEQ ID NO: 2740

SEQ ID NO: 2779 - DNA, 201 bp, Homo sapiens; identical to SEQ ID NO: 2741

SEQ ID NO: 2780 - DNA, 201 bp, Homo sapiens; identical to SEQ ID NO: 2743

SEQ ID NO: 2781 - DNA, 201 bp, Homo sapiens; identical to SEQ ID NO: 2744

SEQ ID NO: 2782 - DNA, 201 bp, Homo sapiens; identical to SEQ ID NO: 2745

SEQ ID NO: 2783 - DNA, 201 bp, Homo sapiens; identical to SEQ ID NO: 2746

SEQ ID NO: 2784 - DNA, 201 bp, Homo sapiens; identical to SEQ ID NO: 2747

SEQ ID NO: 2785 - DNA, 201 bp, Homo sapiens; identical to SEQ ID NO: 2748

SEQ ID NO: 2786 - DNA, 201 bp, Homo sapiens; identical to SEQ ID NO: 2749

SEQ ID NO: 2787 - DNA, 162 bp, Homo sapiens; identical to SEQ ID NO: 2750

SEQ ID NO: 2788 - DNA, 113 bp, Homo sapiens; identical to SEQ ID NO: 2751

SEQ ID NO: 2789 - DNA, 201 bp, Homo sapiens
taaacagattcgaattttacttctgaacgaaatggagaaactggaaaagaccctcttcagacttgaacaagggtatgagctacagttccgattaggcccarctttacagggaaaagcagttaccgtgtatacaaattacccatttcctggagaaacatttaatagagaaaaattccgttctctggattgggaaaatccaac

SEQ ID NO: 2790 - DNA, 201 bp, Homo sapiens; identical to SEQ ID NO: 2714

SEQ ID NO: 2791 - DNA, 201 bp, Homo sapiens; identical to SEQ ID NO: 2715

SEQ ID NO: 2792 - DNA, 201 bp, Homo sapiens; identical to SEQ ID NO: 2716

SEQ ID NO: 2793 - DNA, 201 bp, Homo sapiens; identical to SEQ ID NO: 2717

SEQ ID NO: 2794 - DNA, 201 bp, Homo sapiens
cgtataactccctcggcgggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagggtatgagctacagttccgattaggcccaacttt

SEQ ID NO: 2795 - DNA, 201 bp, Homo sapiens; identical to SEQ ID NO: 2719

SEQ ID NO: 2796 - DNA, 201 bp, Homo sapiens; identical to SEQ ID NO: 2720

SEQ ID NO: 2797 - DNA, 201 bp, Homo sapiens; identical to SEQ ID NO: 2721

SEQ ID NO: 2798 - DNA, 201 bp, Homo sapiens; identical to SEQ ID NO: 2722

SEQ ID NO: 2799 - DNA, 201 bp, Homo sapiens; identical to SEQ ID NO: 2723

SEQ ID NO: 2800 - DNA, 201 bp, Homo sapiens; identical to SEQ ID NO: 2724

SEQ ID NO: 2801 - DNA, 201 bp, Homo sapiens; identical to SEQ ID NO: 2725

SEQ ID NO: 2802 - DNA, 201 bp, Homo sapiens
gtcctgcagtgccccagaagccgcacgtataactccctcggcgggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagggtatgagc

SEQ ID NO: 2803 - DNA, 201 bp, Homo sapiens; identical to SEQ ID NO: 2727

SEQ ID NO: 2804 - DNA, 201 bp, Homo sapiens; identical to SEQ ID NO: 2728

SEQ ID NO: 2805 - DNA, 201 bp, Homo sapiens
ccctttgcccttcacggcgcccggccctccttgggctgcggcttctgtgcgaggctgggcagccagcccttccccttctgtttctccccgtcccctccccscgaccgtagcaccagagtcgcgggtcctgcagtgccccagaagccgcacgtataactccctcggcgggtaactcattcgactgtggagttcttttaattc

SEQ ID NO: 2806 - DNA, 201 bp, Homo sapiens; identical to SEQ ID NO: 2729

SEQ ID NO: 2807 - DNA, 201 bp, Homo sapiens; identical to SEQ ID NO: 2730

SEQ ID NO: 2808 - DNA, 201 bp, Homo sapiens; identical to SEQ ID NO: 2731

SEQ ID NO: 2809 - DNA, 201 bp, Homo sapiens; identical to SEQ ID NO: 2732

SEQ ID NO: 2810 - DNA, 201 bp, Homo sapiens; identical to SEQ ID NO: 2733

SEQ ID NO: 2811 - DNA, 201 bp, Homo sapiens; identical to SEQ ID NO: 2734

SEQ ID NO: 2812 - DNA, 201 bp, Homo sapiens; identical to SEQ ID NO: 2735

SEQ ID NO: 2813 - DNA, 201 bp, Homo sapiens; identical to SEQ ID NO: 2736

SEQ ID NO: 2814 - DNA, 201 bp, Homo sapiens; identical to SEQ ID NO: 2737

SEQ ID NO: 2815 - DNA, 201 bp, Homo sapiens; identical to SEQ ID NO: 2738

SEQ ID NO: 2816 - DNA, 201 bp, Homo sapiens; identical to SEQ ID NO: 2739

SEQ ID NO: 2817 - DNA, 201 bp, Homo sapiens; identical to SEQ ID NO: 2740

SEQ ID NO: 2818 - DNA, 201 bp, Homo sapiens; identical to SEQ ID NO: 2741

SEQ ID NO: 2819 - DNA, 201 bp, Homo sapiens; identical to SEQ ID NO: 2743

SEQ ID NO: 2820 - DNA, 201 bp, Homo sapiens; identical to SEQ ID NO: 2744

SEQ ID NO: 2821 - DNA, 201 bp, Homo sapiens; identical to SEQ ID NO: 2745

SEQ ID NO: 2822 - DNA, 201 bp, Homo sapiens; identical to SEQ ID NO: 2746

SEQ ID NO: 2823 - DNA, 201 bp, Homo sapiens; identical to SEQ ID NO: 2747

SEQ ID NO: 2824 - DNA, 201 bp, Homo sapiens; identical to SEQ ID NO: 2748

SEQ ID NO: 2825 - DNA, 201 bp, Homo sapiens; identical to SEQ ID NO: 2749

SEQ ID NO: 2826 - DNA, 162 bp, Homo sapiens; identical to SEQ ID NO: 2750

SEQ ID NO: 2827 - DNA, 113 bp, Homo sapiens; identical to SEQ ID NO: 2751

SEQ ID NO: 2828 - DNA, 201 bp, Homo sapiens; identical to SEQ ID NO: 2789

SEQ ID NO: 2829 - DNA, 201 bp, Homo sapiens; identical to SEQ ID NO: 2714

SEQ ID NO: 2830 - DNA, 201 bp, Homo sapiens; identical to SEQ ID NO: 2715

SEQ ID NO: 2831 - DNA, 201 bp, Homo sapiens; identical to SEQ ID NO: 2716

SEQ ID NO: 2832 - DNA, 201 bp, Homo sapiens; identical to SEQ ID NO: 2717

SEQ ID NO: 2833 - DNA, 201 bp, Homo sapiens
aaacacacttcgaacatgggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagggtatgagctacagttccgattaggcccaacttt

SEQ ID NO: 2834 - DNA, 201 bp, Homo sapiens; identical to SEQ ID NO: 2719

SEQ ID NO: 2835 - DNA, 201 bp, Homo sapiens; identical to SEQ ID NO: 2720

SEQ ID NO: 2836 - DNA, 201 bp, Homo sapiens; identical to SEQ ID NO: 2721

SEQ ID NO: 2837 - DNA, 201 bp, Homo sapiens; identical to SEQ ID NO: 2722

SEQ ID NO: 2838 - DNA, 201 bp, Homo sapiens; identical to SEQ ID NO: 2723

SEQ ID NO: 2839 - DNA, 201 bp, Homo sapiens; identical to SEQ ID NO: 2724

SEQ ID NO: 2840 - DNA, 201 bp, Homo sapiens; identical to SEQ ID NO: 2725

SEQ ID NO: 2841 - DNA, 201 bp, Homo sapiens
ctctttcattgctctgctaggcataaaacacacttcgaacatgggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagggtatgagc

SEQ ID NO: 2842 - DNA, 201 bp, Homo sapiens; identical to SEQ ID NO: 2727

SEQ ID NO: 2843 - DNA, 201 bp, Homo sapiens; identical to SEQ ID NO: 2728

SEQ ID NO: 2844 - DNA, 201 bp, Homo sapiens; identical to SEQ ID NO: 2729

SEQ ID NO: 2845 - DNA, 201 bp, Homo sapiens; identical to SEQ ID NO: 2730

SEQ ID NO: 2846 - DNA, 201 bp, Homo sapiens; identical to SEQ ID NO: 2731

SEQ ID NO: 2847 - DNA, 201 bp, Homo sapiens; identical to SEQ ID NO: 2732

SEQ ID NO: 2848 - DNA, 201 bp, Homo sapiens; identical to SEQ ID NO: 2733

SEQ ID NO: 2849 - DNA, 201 bp, Homo sapiens; identical to SEQ ID NO: 2734

SEQ ID NO: 2850 - DNA, 201 bp, Homo sapiens; identical to SEQ ID NO: 2735

SEQ ID NO: 2851 - DNA, 201 bp, Homo sapiens; identical to SEQ ID NO: 2736

SEQ ID NO: 2852 - DNA, 201 bp, Homo sapiens; identical to SEQ ID NO: 2737

SEQ ID NO: 2853 - DNA, 201 bp, Homo sapiens; identical to SEQ ID NO: 2738

SEQ ID NO: 2854 - DNA, 201 bp, Homo sapiens; identical to SEQ ID NO: 2739

SEQ ID NO: 2855 - DNA, 201 bp, Homo sapiens; identical to SEQ ID NO: 2740

SEQ ID NO: 2856 - DNA, 201 bp, Homo sapiens; identical to SEQ ID NO: 2741

SEQ ID NO: 2857 - DNA, 201 bp, Homo sapiens; identical to SEQ ID NO: 2743

SEQ ID NO: 2858 - DNA, 201 bp, Homo sapiens; identical to SEQ ID NO: 2744

SEQ ID NO: 2859 - DNA, 201 bp, Homo sapiens; identical to SEQ ID NO: 2745

SEQ ID NO: 2860 - DNA, 201 bp, Homo sapiens; identical to SEQ ID NO: 2746

SEQ ID NO: 2861 - DNA, 201 bp, Homo sapiens; identical to SEQ ID NO: 2747

SEQ ID NO: 2862 - DNA, 201 bp, Homo sapiens; identical to SEQ ID NO: 2748

SEQ ID NO: 2863 - DNA, 201 bp, Homo sapiens; identical to SEQ ID NO: 2749

SEQ ID NO: 2864 - DNA, 162 bp, Homo sapiens; identical to SEQ ID NO: 2750

SEQ ID NO: 2865 - DNA, 113 bp, Homo sapiens; identical to SEQ ID NO: 2751

SEQ ID NO: 2866 - DNA, 201 bp, Homo sapiens; identical to SEQ ID NO: 2789

SEQ ID NO: 2867 - DNA, 201 bp, Homo sapiens; identical to SEQ ID NO: 2714

SEQ ID NO: 2868 - DNA, 201 bp, Homo sapiens; identical to SEQ ID NO: 2715

SEQ ID NO: 2869 - DNA, 201 bp, Homo sapiens; identical to SEQ ID NO: 2716

SEQ ID NO: 2870 - DNA, 201 bp, Homo sapiens; identical to SEQ ID NO: 2717

SEQ ID NO: 2871 - DNA, 201 bp, Homo sapiens
gagcagactaatctcttgggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaagggtatgagctacagttccgattaggcccaacttt

SEQ ID NO: 2872 - DNA, 201 bp, Homo sapiens; identical to SEQ ID NO: 2719

SEQ ID NO: 2873 - DNA, 201 bp, Homo sapiens; identical to SEQ ID NO: 2720

SEQ ID NO: 2874 - DNA, 201 bp, Homo sapiens; identical to SEQ ID NO: 2721

SEQ ID NO: 2875 - DNA, 201 bp, Homo sapiens; identical to SEQ ID NO: 2722

SEQ ID NO: 2876 - DNA, 201 bp, Homo sapiens; identical to SEQ ID NO: 2723

SEQ ID NO: 2877 - DNA, 201 bp, Homo sapiens; identical to SEQ ID NO: 2724

SEQ ID NO: 2878 - DNA, 201 bp, Homo sapiens; identical to SEQ ID NO: 2725

SEQ ID NO: 2879 - DNA, 201 bp, Homo sapiens
gggagattgcccacctgttatctttgagcagactaatctcttgggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaagggtatgagc

SEQ ID NO: 2880 - DNA, 201 bp, Homo sapiens; identical to SEQ ID NO: 2727

SEQ ID NO: 2881 - DNA, 201 bp, Homo sapiens; identical to SEQ ID NO: 2728

SEQ ID NO: 2882 - DNA, 201 bp, Homo sapiens; identical to SEQ ID NO: 2729

SEQ ID NO: 2883 - DNA, 201 bp, Homo sapiens; identical to SEQ ID NO: 2730

SEQ ID NO: 2884 - DNA, 201 bp, Homo sapiens; identical to SEQ ID NO: 2731

SEQ ID NO: 2885 - DNA, 201 bp, Homo sapiens; identical to SEQ ID NO: 2732

SEQ ID NO: 2886 - DNA, 201 bp, Homo sapiens; identical to SEQ ID NO: 2733

SEQ ID NO: 2887 - DNA, 201 bp, Homo sapiens; identical to SEQ ID NO: 2734

SEQ ID NO: 2888 - DNA, 201 bp, Homo sapiens; identical to SEQ ID NO: 2735

SEQ ID NO: 2889 - DNA, 201 bp, Homo sapiens; identical to SEQ ID NO: 2736

SEQ ID NO: 2890 - DNA, 201 bp, Homo sapiens; identical to SEQ ID NO: 2737

SEQ ID NO: 2891 - DNA, 201 bp, Homo sapiens; identical to SEQ ID NO: 2738

SEQ ID NO: 2892 - DNA, 201 bp, Homo sapiens; identical to SEQ ID NO: 2739

SEQ ID NO: 2893 - DNA, 201 bp, Homo sapiens; identical to SEQ ID NO: 2740

SEQ ID NO: 2894 - DNA, 201 bp, Homo sapiens; identical to SEQ ID NO: 2741

SEQ ID NO: 2895 - DNA, 201 bp, Homo sapiens; identical to SEQ ID NO: 2743

SEQ ID NO: 2896 - DNA, 201 bp, Homo sapiens; identical to SEQ ID NO: 2744

SEQ ID NO: 2897 - DNA, 201 bp, Homo sapiens; identical to SEQ ID NO: 2745

SEQ ID NO: 2898 - DNA, 201 bp, Homo sapiens; identical to SEQ ID NO: 2746

SEQ ID NO: 2899 - DNA, 201 bp, Homo sapiens; identical to SEQ ID NO: 2747

SEQ ID NO: 2900 - DNA, 201 bp, Homo sapiens; identical to SEQ ID NO: 2748

SEQ ID NO: 2901 - DNA, 201 bp, Homo sapiens; identical to SEQ ID NO: 2749

SEQ ID NO: 2902 - DNA, 162 bp, Homo sapiens; identical to SEQ ID NO: 2750

SEQ ID NO: 2903 - DNA, 113 bp, Homo sapiens; identical to SEQ ID NO: 2751

SEQ ID NO: 2904 - DNA, 201 bp, Homo sapiens; identical to SEQ ID NO: 2752

SEQ ID NO: 2905 - DNA, 201 bp, Homo sapiens; identical to SEQ ID NO: 2753

SEQ ID NO: 2906 - DNA, 201 bp, Homo sapiens; identical to SEQ ID NO: 2714

SEQ ID NO: 2907 - DNA, 201 bp, Homo sapiens; identical to SEQ ID NO: 2715

SEQ ID NO: 2908 - DNA, 201 bp, Homo sapiens; identical to SEQ ID NO: 2716

SEQ ID NO: 2909 - DNA, 201 bp, Homo sapiens
gatttcagtggtttctgaagaacggttttacactaagtggaatcctgaagcattgccttcaaacacaggtgaagttaatttccaaagcggcattattgcakccaggtgtgctatcagtaaacttcatcaggagcttggagccaaggttgttctttctgcttctcaggtgtatgtggatcaagttgatgaagacatagtggc

SEQ ID NO: 2910 - DNA, 201 bp, Homo sapiens; identical to SEQ ID NO: 2719

SEQ ID NO: 2911 - DNA, 201 bp, Homo sapiens; identical to SEQ ID NO: 2720

SEQ ID NO: 2912 - DNA, 201 bp, Homo sapiens; identical to SEQ ID NO: 2721

SEQ ID NO: 2913 - DNA, 201 bp, Homo sapiens; identical to SEQ ID NO: 2722

SEQ ID NO: 2914 - DNA, 201 bp, Homo sapiens; identical to SEQ ID NO: 2723

SEQ ID NO: 2915 - DNA, 201 bp, Homo sapiens; identical to SEQ ID NO: 2724

SEQ ID NO: 2916 - DNA, 201 bp, Homo sapiens; identical to SEQ ID NO: 2725

SEQ ID NO: 2917 - DNA, 201 bp, Homo sapiens; identical to SEQ ID NO: 2727

SEQ ID NO: 2918 - DNA, 201 bp, Homo sapiens; identical to SEQ ID NO: 2728

SEQ ID NO: 2919 - DNA, 201 bp, Homo sapiens; identical to SEQ ID NO: 2729

SEQ ID NO: 2920 - DNA, 201 bp, Homo sapiens; identical to SEQ ID NO: 2730

SEQ ID NO: 2921 - DNA, 201 bp, Homo sapiens; identical to SEQ ID NO: 2731

SEQ ID NO: 2922 - DNA, 201 bp, Homo sapiens; identical to SEQ ID NO: 2732

SEQ ID NO: 2923 - DNA, 201 bp, Homo sapiens; identical to SEQ ID NO: 2733

SEQ ID NO: 2924 - DNA, 201 bp, Homo sapiens; identical to SEQ ID NO: 2734

SEQ ID NO: 2925 - DNA, 201 bp, Homo sapiens; identical to SEQ ID NO: 2735

SEQ ID NO: 2926 - DNA, 201 bp, Homo sapiens; identical to SEQ ID NO: 2736

SEQ ID NO: 2927 - DNA, 201 bp, Homo sapiens; identical to SEQ ID NO: 2737

SEQ ID NO: 2928 - DNA, 201 bp, Homo sapiens; identical to SEQ ID NO: 2738

SEQ ID NO: 2929 - DNA, 201 bp, Homo sapiens; identical to SEQ ID NO: 2739

SEQ ID NO: 2930 - DNA, 201 bp, Homo sapiens; identical to SEQ ID NO: 2740

SEQ ID NO: 2931 - DNA, 201 bp, Homo sapiens; identical to SEQ ID NO: 2741

SEQ ID NO: 2932 - DNA, 201 bp, Homo sapiens; identical to SEQ ID NO: 2743

SEQ ID NO: 2933 - DNA, 201 bp, Homo sapiens; identical to SEQ ID NO: 2744

SEQ ID NO: 2934 - DNA, 201 bp, Homo sapiens; identical to SEQ ID NO: 2745

SEQ ID NO: 2935 - DNA, 201 bp, Homo sapiens; identical to SEQ ID NO: 2746

SEQ ID NO: 2936 - DNA, 201 bp, Homo sapiens; identical to SEQ ID NO: 2747

SEQ ID NO: 2937 - DNA, 201 bp, Homo sapiens; identical to SEQ ID NO: 2748

SEQ ID NO: 2938 - DNA, 201 bp, Homo sapiens; identical to SEQ ID NO: 2749

SEQ ID NO: 2939 - DNA, 162 bp, Homo sapiens; identical to SEQ ID NO: 2750

SEQ ID NO: 2940 - DNA, 113 bp, Homo sapiens; identical to SEQ ID NO: 2751

SEQ ID NO: 2941 - DNA, 201 bp, Homo sapiens; identical to SEQ ID NO: 2789

SEQ ID NO: 2942 - DNA, 201 bp, Homo sapiens; identical to SEQ ID NO: 2714

SEQ ID NO: 2943 - DNA, 201 bp, Homo sapiens; identical to SEQ ID NO: 2715

SEQ ID NO: 2944 - DNA, 201 bp, Homo sapiens; identical to SEQ ID NO: 2716

SEQ ID NO: 2945 - DNA, 201 bp, Homo sapiens; identical to SEQ ID NO: 2717

SEQ ID NO: 2946 - DNA, 201 bp, Homo sapiens
ccccattggtggctggcgacccgaatttgggaatggggagattgcccacctgttatctttgagcagactaatctcttaagccaaaatgggacacagtaaayagattcgaattttacttctgaacgaaatggagaaactggaaaagaccctcttcagacttgaacaagggtatgagctacagttccgattaggcccaacttt

SEQ ID NO: 2947 - DNA, 201 bp, Homo sapiens; identical to SEQ ID NO: 2719

SEQ ID NO: 2948 - DNA, 201 bp, Homo sapiens; identical to SEQ ID NO: 2720

SEQ ID NO: 2949 - DNA, 201 bp, Homo sapiens; identical to SEQ ID NO: 2721

SEQ ID NO: 2950 - DNA, 201 bp, Homo sapiens; identical to SEQ ID NO: 2722

SEQ ID NO: 2951 - DNA, 201 bp, Homo sapiens; identical to SEQ ID NO: 2723

SEQ ID NO: 2952 - DNA, 201 bp, Homo sapiens; identical to SEQ ID NO: 2724

SEQ ID NO: 2953 - DNA, 201 bp, Homo sapiens; identical to SEQ ID NO: 2725

SEQ ID NO: 2954 - DNA, 201 bp, Homo sapiens; identical to SEQ ID NO: 2727

SEQ ID NO: 2955 - DNA, 201 bp, Homo sapiens; identical to SEQ ID NO: 2728

SEQ ID NO: 2956 - DNA, 201 bp, Homo sapiens; identical to SEQ ID NO: 2729

SEQ ID NO: 2957 - DNA, 201 bp, Homo sapiens; identical to SEQ ID NO: 2730

SEQ ID NO: 2958 - DNA, 201 bp, Homo sapiens; identical to SEQ ID NO: 2731

SEQ ID NO: 2959 - DNA, 201 bp, Homo sapiens; identical to SEQ ID NO: 2732

SEQ ID NO: 2960 - DNA, 201 bp, Homo sapiens; identical to SEQ ID NO: 2733

SEQ ID NO: 2961 - DNA, 201 bp, Homo sapiens; identical to SEQ ID NO: 2734

SEQ ID NO: 2962 - DNA, 201 bp, Homo sapiens; identical to SEQ ID NO: 2735

SEQ ID NO: 2963 - DNA, 201 bp, Homo sapiens; identical to SEQ ID NO: 2736

SEQ ID NO: 2964 - DNA, 201 bp, Homo sapiens; identical to SEQ ID NO: 2737

SEQ ID NO: 2965 - DNA, 201 bp, Homo sapiens; identical to SEQ ID NO: 2738

SEQ ID NO: 2966 - DNA, 201 bp, Homo sapiens; identical to SEQ ID NO: 2739

SEQ ID NO: 2967 - DNA, 201 bp, Homo sapiens; identical to SEQ ID NO: 2740

SEQ ID NO: 2968 - DNA, 201 bp, Homo sapiens; identical to SEQ ID NO: 2741

SEQ ID NO: 2969 - DNA, 201 bp, Homo sapiens
cctctgttctcatctccccattggtggctggcgacccgaatttgggaatggggagattgcccacctgttatctttgagcagactaatctcttaagccaaartgggacacagtaaacagattcgaattttacttctgaacgaaatggagaaactggaaaagaccctcttcagacttgaacaagggtatgagctacagttccg

SEQ ID NO: 2970 - DNA, 201 bp, Homo sapiens; identical to SEQ ID NO: 2743

SEQ ID NO: 2971 - DNA, 201 bp, Homo sapiens; identical to SEQ ID NO: 2744

SEQ ID NO: 2972 - DNA, 201 bp, Homo sapiens; identical to SEQ ID NO: 2745

SEQ ID NO: 2973 - DNA, 201 bp, Homo sapiens; identical to SEQ ID NO: 2746

SEQ ID NO: 2974 - DNA, 201 bp, Homo sapiens; identical to SEQ ID NO: 2747

SEQ ID NO: 2975 - DNA, 201 bp, Homo sapiens; identical to SEQ ID NO: 2748

SEQ ID NO: 2976 - DNA, 201 bp, Homo sapiens; identical to SEQ ID NO: 2749

SEQ ID NO: 2977 - DNA, 162 bp, Homo sapiens; identical to SEQ ID NO: 2750

SEQ ID NO: 2978 - DNA, 113 bp, Homo sapiens; identical to SEQ ID NO: 2751

SEQ ID NO: 2979 - DNA, 201 bp, Homo sapiens; identical to SEQ ID NO: 2789

SEQ ID NO: 2980 - DNA, 201 bp, Homo sapiens; identical to SEQ ID NO: 2714

SEQ ID NO: 2981 - DNA, 201 bp, Homo sapiens; identical to SEQ ID NO: 2715

SEQ ID NO: 2982 - DNA, 201 bp, Homo sapiens; identical to SEQ ID NO: 2716

SEQ ID NO: 2983 - DNA, 201 bp, Homo sapiens; identical to SEQ ID NO: 2909

SEQ ID NO: 2984 - DNA, 201 bp, Homo sapiens; identical to SEQ ID NO: 2794

SEQ ID NO: 2985 - DNA, 201 bp, Homo sapiens; identical to SEQ ID NO: 2719

SEQ ID NO: 2986 - DNA, 201 bp, Homo sapiens; identical to SEQ ID NO: 2720

SEQ ID NO: 2987 - DNA, 201 bp, Homo sapiens; identical to SEQ ID NO: 2721

SEQ ID NO: 2988 - DNA, 201 bp, Homo sapiens; identical to SEQ ID NO: 2722

SEQ ID NO: 2989 - DNA, 201 bp, Homo sapiens; identical to SEQ ID NO: 2723

SEQ ID NO: 2990 - DNA, 201 bp, Homo sapiens; identical to SEQ ID NO: 2724

SEQ ID NO: 2991 - DNA, 201 bp, Homo sapiens; identical to SEQ ID NO: 2725

SEQ ID NO: 2992 - DNA, 201 bp, Homo sapiens; identical to SEQ ID NO: 2802

SEQ ID NO: 2993 - DNA, 201 bp, Homo sapiens; identical to SEQ ID NO: 2727

SEQ ID NO: 2994 - DNA, 201 bp, Homo sapiens; identical to SEQ ID NO: 2728

SEQ ID NO: 2995 - DNA, 201 bp, Homo sapiens; identical to SEQ ID NO: 2805

SEQ ID NO: 2996 - DNA, 201 bp, Homo sapiens; identical to SEQ ID NO: 2729

SEQ ID NO: 2997 - DNA, 201 bp, Homo sapiens; identical to SEQ ID NO: 2730

SEQ ID NO: 2998 - DNA, 201 bp, Homo sapiens; identical to SEQ ID NO: 2731

SEQ ID NO: 2999 - DNA, 201 bp, Homo sapiens; identical to SEQ ID NO: 2732

SEQ ID NO: 3000 - DNA, 201 bp, Homo sapiens; identical to SEQ ID NO: 2733

SEQ ID NO: 3001 - DNA, 201 bp, Homo sapiens; identical to SEQ ID NO: 2734

SEQ ID NO: 3002 - DNA, 201 bp, Homo sapiens; identical to SEQ ID NO: 2735

SEQ ID NO: 3003 - DNA, 201 bp, Homo sapiens; identical to SEQ ID NO: 2736

SEQ ID NO: 3004 - DNA, 201 bp, Homo sapiens; identical to SEQ ID NO: 2737

SEQ ID NO: 3005 - DNA, 201 bp, Homo sapiens; identical to SEQ ID NO: 2738

SEQ ID NO: 3006 - DNA, 201 bp, Homo sapiens; identical to SEQ ID NO: 2739

SEQ ID NO: 3007 - DNA, 201 bp, Homo sapiens; identical to SEQ ID NO: 2740

SEQ ID NO: 3008 - DNA, 201 bp, Homo sapiens; identical to SEQ ID NO: 2741

SEQ ID NO: 3009 - DNA, 201 bp, Homo sapiens; identical to SEQ ID NO: 2743

SEQ ID NO: 3010 - DNA, 201 bp, Homo sapiens; identical to SEQ ID NO: 2744

SEQ ID NO: 3011 - DNA, 201 bp, Homo sapiens; identical to SEQ ID NO: 2745

SEQ ID NO: 3012 - DNA, 201 bp, Homo sapiens; identical to SEQ ID NO: 2746

SEQ ID NO: 3013 - DNA, 201 bp, Homo sapiens; identical to SEQ ID NO: 2747

SEQ ID NO: 3014 - DNA, 201 bp, Homo sapiens; identical to SEQ ID NO: 2748

SEQ ID NO: 3015 - DNA, 201 bp, Homo sapiens; identical to SEQ ID NO: 2749

SEQ ID NO: 3016 - DNA, 162 bp, Homo sapiens; identical to SEQ ID NO: 2750

SEQ ID NO: 3017 - DNA, 113 bp, Homo sapiens; identical to SEQ ID NO: 2751

SEQ ID NO: 3018 - DNA, 173 bp, Homo sapiens
gcgcccgccccgcccggcaagatgctgcccgtgtaccaggaggtgaagcccaacccgctgcaggacgcgaacmtctgctcacgcgtgttcttctgatggagtctcgctgtgtcacccaggctggagtgcagtggcgcagtctcagctcactgcagcctccacctcctgtgttc

SEQ ID NO: 3019 - DNA, 201 bp, Homo sapiens
gtattcagtgctgccagaagaccgctcacagcaccttggagaggagttgcaagggttctgggataaagaagttttaagagctgagaatgacgcacagaagscttctttaacaagagcaatcataaagtgttactggaaatcttatttagttttgggaatttttacgttaattgaggaaagtgccaaagtaatccagcccat

SEQ ID NO: 3020 - DNA, 201 bp, Homo sapiens
tgccacggtgctgactttttgcacgctcattttggctatactgcatcacttatatttttatcacgttcagtgtgctgggatgaggttacgagtagccatgkgccatatgatttatcggaaggcacttcgtcttagtaacatggccatggggaagacaaccacaggccagatagtcaatctgctgtccaatgatgtgaacaa

SEQ ID NO: 3021 - DNA, 201 bp, Homo sapiens
ctgcatcacttatatttttatcacgttcagtgtgctgggatgaggttacgagtagccatgtgccatatgatttatcggaaggcacttcgtcttagtaacayggccatggggaagacaaccacaggccagatagtcaatctgctgtccaatgatgtgaacaagtttgatcaggtgacagtgttcttacacttcctgtgggca

SEQ ID NO: 3022 - DNA, 201 bp, Homo sapiens
cttatatttttatcacgttcagtgtgctgggatgaggttacgagtagccatgtgccatatgatttatcggaaggcacttcgtcttagtaacatggccatgkggaagacaaccacaggccagatagtcaatctgctgtccaatgatgtgaacaagtttgatcaggtgacagtgttcttacacttcctgtgggcaggaccact

SEQ ID NO: 3023 - DNA, 201 bp, Homo sapiens
ccacaggccagatagtcaatctgctgtccaatgatgtgaacaagtttgatcaggtgacagtgttcttacacttcctgtgggcaggaccactgcaggcgatygcagtgactgccctactctggatggagataggaatatcgtgccttgctgggatggcagttctaatcattctcctgcccttgcaaagctgttttgggaagt

SEQ ID NO: 3024 - DNA, 201 bp, Homo sapiens
atcaggtgacagtgttcttacacttcctgtgggcaggaccactgcaggcgattgcagtgactgccctactctggatggagataggaatatcgtgccttgcygggatggcagttctaatcattctcctgcccttgcaaagctgttttgggaagttgttctcatcactgaggagtaaaactgcaactttcacggatgccagga

SEQ ID NO: 3025 - DNA, 201 bp, Homo sapiens
tcttacacttcctgtgggcaggaccactgcaggcgattgcagtgactgccctactctggatggagataggaatatcgtgccttgctgggatggcagttctratcattctcctgcccttgcaaagctgttttgggaagttgttctcatcactgaggagtaaaactgcaactttcacggatgccaggatcaggaccatgaatg

SEQ ID NO: 3026 - DNA, 201 bp, Homo sapiens
atcactgaggagtaaaactgcaactttcacggatgccaggatcaggaccatgaatgaagttataactggtataaggataataaaaatgtacgcctgggaaragtcattttcaaatcttattaccaatttgagaaagaaggagatttccaagattctgagaagttcctgcctcagagggatgaatttggcttcatttttcag

SEQ ID NO: 3027 - DNA, 201 bp, Homo sapiens
ccaggatcaggaccatgaatgaagttataactggtataaggataataaaaatgtacgcctgggaaaagtcattttcaaatcttattaccaatttgagaaakaaggagatttccaagattctgagaagttcctgcctcagagggatgaatttggcttcatttttcagtgcaagcaaaatcatcgtgtttgtgaccttcacca

SEQ ID NO: 3028 - DNA, 201 bp, Homo sapiens
aggataataaaaatgtacgcctgggaaaagtcattttcaaatcttattaccaatttgagaaagaaggagatttccaagattctgagaagttcctgcctcaragggatgaatttggcttcatttttcagtgcaagcaaaatcatcgtgtttgtgaccttcaccacctacgtgctcctcggcagtgtgatcacagccagccgc

SEQ ID NO: 3029 - DNA, 201 bp, Homo sapiens
ggataataaaaatgtacgcctgggaaaagtcattttcaaatcttattaccaatttgagaaagaaggagatttccaagattctgagaagttcctgcctcagrgggatgaatttggcttcatttttcagtgcaagcaaaatcatcgtgtttgtgaccttcaccacctacgtgctcctcggcagtgtgatcacagccagccgcg

SEQ ID NO: 3030 - DNA, 201 bp, Homo sapiens
cctgggaaaagtcattttcaaatcttattaccaatttgagaaagaaggagatttccaagattctgagaagttcctgcctcagagggatgaatttggcttcrtttttcagtgcaagcaaaatcatcgtgtttgtgaccttcaccacctacgtgctcctcggcagtgtgatcacagccagccgcgtgttcgtggcagtgacgc

SEQ ID NO: 3031 - DNA, 201 bp, Homo sapiens
gaagttcctgcctcagagggatgaatttggcttcatttttcagtgcaagcaaaatcatcgtgtttgtgaccttcaccacctacgtgctcctcggcagtgtratcacagccagccgcgtgttcgtggcagtgacgctgtatggggctgtgcggctgacggttaccctcttcttcccctcagccattgagagggtgtcagagg

SEQ ID NO: 3032 - DNA, 201 bp, Homo sapiens
tcatttttcagtgcaagcaaaatcatcgtgtttgtgaccttcaccacctacgtgctcctcggcagtgtgatcacagccagccgcgtgttcgtggcagtgaygctgtatggggctgtgcggctgacggttaccctcttcttcccctcagccattgagagggtgtcagaggcaatcgtcagcatccgaagaatccagaccttt

SEQ ID NO: 3033 - DNA, 201 bp, Homo sapiens
ccctcagccattgagagggtgtcagaggcaatcgtcagcatccgaagaatccagacctttttgctacttgatgagatatcacagcgcaaccgtcagctgcygtcagatggtaaaaagatggtgcatgtgcaggattttactgctttttgggataaggcatcagagaccccaactctacaaggcctttcctttactgtcaga

SEQ ID NO: 3034 - DNA, 201 bp, Homo sapiens
ctttttgggataaggcatcagagaccccaactctacaaggcctttcctttactgtcagacctggcgaattgttagctgtggtcggccccgtgggagcaggraagtcatcactgttaagtgccgtgctcggggaattggccccaagtcacgggctggtcagcgtgcatggaagaattgcctatgtgtctcagcagccctggg

SEQ ID NO: 3035 - DNA, 201 bp, Homo sapiens
cactgttaagtgccgtgctcggggaattggccccaagtcacgggctggtcagcgtgcatggaagaattgcctatgtgtctcagcagccctgggtgttctcrggaactctgaggagtaatattttatttgggaagaaatacgaaaaggaacgatatgaaaaagtcataaaggcttgtgctctgaaaaaggatttacagctgt

SEQ ID NO: 3036 - DNA, 201 bp, Homo sapiens
ctgttaagtgccgtgctcggggaattggccccaagtcacgggctggtcagcgtgcatggaagaattgcctatgtgtctcagcagccctgggtgttctcggraactctgaggagtaatattttatttgggaagaaatacgaaaaggaacgatatgaaaaagtcataaaggcttgtgctctgaaaaaggatttacagctgttg

SEQ ID NO: 3037 - DNA, 201 bp, Homo sapiens
aagtcacgggctggtcagcgtgcatggaagaattgcctatgtgtctcagcagccctgggtgttctcgggaactctgaggagtaatattttatttgggaagraatacgaaaaggaacgatatgaaaaagtcataaaggcttgtgctctgaaaaaggatttacagctgttggaggatggtgatctgactgtgataggagatcg

SEQ ID NO: 3038 - DNA, 201 bp, Homo sapiens
acgggctggtcagcgtgcatggaagaattgcctatgtgtctcagcagccctgggtgttctcgggaactctgaggagtaatattttatttgggaagaaataygaaaaggaacgatatgaaaaagtcataaaggcttgtgctctgaaaaaggatttacagctgttggaggatggtgatctgactgtgataggagatcggggaa

SEQ ID NO: 3039 - DNA, 201 bp, Homo sapiens
caagagcagtgtatcaagatgctgacatctatctcctggacgatcctctcagtgcagtagatgcggaagttagcagacacttgttcgaactgtgtatttgycaaattttgcatgagaagatcacaattttagtgactcatcagttgcagtacctcaaagctgcaagtcagattctgatattgaaagatggtaaaatggtgc

SEQ ID NO: 3040 - DNA, 195 bp, Homo sapiens
atcagttgcagtacctcaaagctgcaagtcagattctgatattgaaagatggtaaaatggtgcagaaggggacttacactgagttcctaaaatctggtatrgattttggctcccttttaaagaaggataatgaggaaagtgaacaacctccagttccaggaactcccacactaaggaatcgtaccttctcagagt

SEQ ID NO: 3041 - DNA, 201 bp, Homo sapiens
ccctcatctcagccctttttagattgtcagaacccgaaggtaaaatttggattgataagatcttgacaactgaaattggacttcacgatttaaggaagaaratgtcaatcatacctcaggaacctgttttgttcactggaacaatgaggaaaaacctggatccctttaatgagcacacggatgaggaactgtggaatgcct

SEQ ID NO: 3042 - DNA, 201 bp, Homo sapiens
gccgctgccctcactgaaacagcaaaacaggtatacttcaaaagaaattatccacatattggtcacactgaccacatggttacaaacacttccaatggacrgccctcgaccttaactattttcgagacagcactgtgaatccaaccaaaatgtcaagtccgttccgaaggcattttccactagtttttggactatgtaaac

SEQ ID NO: 3043 - DNA, 201 bp, Homo sapiens
cttgccagggcaattctcaggaaaaatcagatattgattattgatgaagcgacggcaaatgtggatccaagaactgatgagttaatacaaaaaaaaatccrggagaaatttgcccactgcaccgtgctaaccattgcacacagattgaacaccattattgacagcgacaagataatggttttagattcaggaagactgaaa

SEQ ID NO: 3044 - DNA, 201 bp, Homo sapiens
ggacttcacgatttaaggaagaagatgtcaatcatacctcaggaacctgttttgttcactggaacaatgaggaaaaacctggatccctttaatgagcacayggatgaggaactgtggaatgccttacaagaggtacaacttaaagaaaccattgaagatcttcctggtaaaatggatactgaattagcagaatcaggatcc

SEQ ID NO: 3045 - DNA, 201 bp, Homo sapiens
tgtcaggaactgtttgatgcacaccaggatttacattcagaggcttggttcttgtttttgacaacgtcccgctggttcgccgtccgtctggatgccatctstgccatgtttgtcatcatcgttgcctttgggtccctgattctggcaaaaactctggatgccgggcaggttggtttggcactgtcctatgccctcacgctc

SEQ ID NO: 3046 - DNA, 201 bp, Homo sapiens
catacaaagcagaagagaggtgtcaggaactgtttgatgcacaccaggatttacattcagaggcttggttcttgtttttgacaacgtcccgctggttcgcygtccgtctggatgccatctgtgccatgtttgtcatcatcgttgcctttgggtccctgattctggcaaaaactctggatgccgggcaggttggtttggcac

SEQ ID NO: 3047 - DNA, 201 bp, Homo sapiens
tagcagaatcaggatccaattttagtgttggacaaagacaactggtgtgccttgccagggcaattctcaggaaaaatcagatattgattattgatgaagcracggcaaatgtggatccaagaactgatgagttaatacaaaaaaaaatccgggagaaatttgcccactgcaccgtgctaaccattgcacacagattgaaca

SEQ ID NO: 3048 - DNA, 201 bp, Homo sapiens; identical to SEQ ID NO: 3033

SEQ ID NO: 3049 - DNA, 201 bp, Homo sapiens
tggatgccatctgtgccatgtttgtcatcatcgttgcctttgggtccctgattctggcaaaaactctggatgccgggcaggttggtttggcactgtcctaygccctcacgctcatggggatgtttcagtggtgtgttcgacaaagtgctgaagttgagaatatgatgatctcagtagaaagggtcattgaatacacagacc

SEQ ID NO: 3050 - DNA, 201 bp, Homo sapiens; identical to SEQ ID NO: 3039

SEQ ID NO: 3051 - DNA, 201 bp, Homo sapiens; identical to SEQ ID NO: 3032

SEQ ID NO: 3052 - DNA, 201 bp, Homo sapiens; identical to SEQ ID NO: 3025

SEQ ID NO: 3053 - DNA, 201 bp, Homo sapiens
actgcaccgtgctaaccattgcacacagattgaacaccattattgacagcgacaagataatggttttagattcaggaagactgaaagaatatgatgagccrtatgttttgctgcaaaataaagagagcctattttacaagatggtgcaacaactgggcaaggcagaagccgctgccctcactgaaacagcaaaacaggtat

SEQ ID NO: 3054 - DNA, 201 bp, Homo sapiens
tcacaaactttgcacaacaaaatgtttgagtcaattctgaaagctccggtattattctttgatagaaatccaataggaagaattttaaatcgtttctccaragacattggacacttggatgatttgctgccgctgacgtttttagatttcatccagacattgctacaagtggttggtgtggtctctgtggctgtggccgtg

SEQ ID NO: 3055 - DNA, 201 bp, Homo sapiens
gggcatacaaagcagaagagaggtgtcaggaactgtttgatgcacaccaggatttacattcagaggcttggttcttgtttttgacaacgtcccgctggttygccgtccgtctggatgccatctgtgccatgtttgtcatcatcgttgcctttgggtccctgattctggcaaaaactctggatgccgggcaggttggtttgg

SEQ ID NO: 3056 - DNA, 201 bp, Homo sapiens; identical to SEQ ID NO: 3024

SEQ ID NO: 3057 - DNA, 201 bp, Homo sapiens; identical to SEQ ID NO: 3022

SEQ ID NO: 3058 - DNA, 201 bp, Homo sapiens; identical to SEQ ID NO: 3037

SEQ ID NO: 3059 - DNA, 201 bp, Homo sapiens
agctcaggttgcctatgtgcttcaagattggtggctttcatactgggcaaacaaacaaagtatgctaaatgtcactgtaaatggaggaggaaatgtaaccragaagctagatcttaactggtacttaggaatttattcaggtttaactgtagctaccgttctttttggcatagcaagatctctattggtattctacgtcct

SEQ ID NO: 3060 - DNA, 201 bp, Homo sapiens
caaagacattggacacttggatgatttgctgccgctgacgtttttagatttcatccagacattgctacaagtggttggtgtggtctctgtggctgtggccrtgattccttggatcgcaatacccttggttccccttggaatcattttcatttttcttcggcgatattttttggaaacgtcaagagatgtgaagcgcctgga

SEQ ID NO: 3061 - DNA, 201 bp, Homo sapiens
ccaaagacattggacacttggatgatttgctgccgctgacgtttttagatttcatccagacattgctacaagtggttggtgtggtctctgtggctgtggcygtgattccttggatcgcaatacccttggttccccttggaatcattttcatttttcttcggcgatattttttggaaacgtcaagagatgtgaagcgcctgg

SEQ ID NO: 3062 - DNA, 201 bp, Homo sapiens; identical to SEQ ID NO: 3026

SEQ ID NO: 3063 - DNA, 152 bp, Homo sapiens
atgctgcccgtgtaccaggaggtgaagcccaacccgctgcaggacgcgaacmtctgctcacgcgtgttcttctggtggctcaatcccttgtttaaaattggccataaacggagattagaggaagatgatatgtattcagtgctgccagaaga

SEQ ID NO: 3064 - DNA, 201 bp, Homo sapiens; identical to SEQ ID NO: 3038

SEQ ID NO: 3065 - DNA, 201 bp, Homo sapiens
ctggattgtcttcattttccttattctcctaaacactgcagctcaggttgcctatgtgcttcaagattggtggctttcatactgggcaaacaaacaaagtrtgctaaatgtcactgtaaatggaggaggaaatgtaaccgagaagctagatcttaactggtacttaggaatttattcaggtttaactgtagctaccgttct

SEQ ID NO: 3066 - DNA, 201 bp, Homo sapiens; identical to SEQ ID NO: 3027

SEQ ID NO: 3067 - DNA, 201 bp, Homo sapiens; identical to SEQ ID NO: 3034

SEQ ID NO: 3068 - DNA, 201 bp, Homo sapiens
tgaaggagtgataatctttgacaatgtgaacttcatgtacagtccaggtgggcctctggtactgaagcatctgacagcactcattaaatcacaagaaaagrttggcattgtgggaagaaccggagctggaaaaagttccctcatctcagccctttttagattgtcagaacccgaaggtaaaatttggattgataagatctt

SEQ ID NO: 3069 - DNA, 201 bp, Homo sapiens
ttggaatcattttcatttttcttcggcgatattttttggaaacgtcaagagatgtgaagcgcctggaatctacaactcggagtccagtgttttcccacttrtcatcttctctccaggggctctggaccatccgggcatacaaagcagaagagaggtgtcaggaactgtttgatgcacaccaggatttacattcagaggctt

SEQ ID NO: 3070 - DNA, 201 bp, Homo sapiens
aattttaaatcgtttctccaaagacattggacacttggatgatttgctgccgctgacgtttttagatttcatccagacattgctacaagtggttggtgtgktctctgtggctgtggccgtgattccttggatcgcaatacccttggttccccttggaatcattttcatttttcttcggcgatattttttggaaacgtcaag

SEQ ID NO: 3071 - DNA, 201 bp, Homo sapiens
taaccgagaagctagatcttaactggtacttaggaatttattcaggtttaactgtagctaccgttctttttggcatagcaagatctctattggtattctaygtccttgttaactcttcacaaactttgcacaacaaaatgtttgagtcaattctgaaagctccggtattattctttgatagaaatccaataggaagaattt

SEQ ID NO: 3072 - DNA, 201 bp, Homo sapiens
cctccttgaaagatggtgctctggagagccaagatacagagaatgtcccagttacactatcagaggagaaccgttctgaaggaaaagttggttttcaggcytataagaattacttcagagctggtgctcactggattgtcttcattttccttattctcctaaacactgcagctcaggttgcctatgtgcttcaagattggt

SEQ ID NO: 3073 - DNA, 201 bp, Homo sapiens
ataatgaggaaagtgaacaacctccagttccaggaactcccacactaaggaatcgtaccttctcagagtcttcggtttggtctcaacaatcttctagaccytccttgaaagatggtgctctggagagccaagatacagagaatgtcccagttacactatcagaggagaaccgttctgaaggaaaagttggttttcaggcct

SEQ ID NO: 3074 - DNA, 201 bp, Homo sapiens; identical to SEQ ID NO: 3035

SEQ ID NO: 3075 - DNA, 201 bp, Homo sapiens; identical to SEQ ID NO: 3019

SEQ ID NO: 3076 - DNA, 201 bp, Homo sapiens
ggttggcattgtgggaagaaccggagctggaaaaagttccctcatctcagccctttttagattgtcagaacccgaaggtaaaatttggattgataagatcytgacaactgaaattggacttcacgatttaaggaagaagatgtcaatcatacctcaggaacctgttttgttcactggaacaatgaggaaaaacctggatcc

SEQ ID NO: 3077 - DNA, 201 bp, Homo sapiens
caggtgggcctctggtactgaagcatctgacagcactcattaaatcacaagaaaaggttggcattgtgggaagaaccggagctggaaaaagttccctcatmtcagccctttttagattgtcagaacccgaaggtaaaatttggattgataagatcttgacaactgaaattggacttcacgatttaaggaagaagatgtcaa

SEQ ID NO: 3078 - DNA, 201 bp, Homo sapiens; identical to SEQ ID NO: 3030

SEQ ID NO: 3079 - DNA, 201 bp, Homo sapiens; identical to SEQ ID NO: 3029

SEQ ID NO: 3080 - DNA, 201 bp, Homo sapiens
ttctacgtccttgttaactcttcacaaactttgcacaacaaaatgtttgagtcaattctgaaagctccggtattattctttgatagaaatccaataggaakaattttaaatcgtttctccaaagacattggacacttggatgatttgctgccgctgacgtttttagatttcatccagacattgctacaagtggttggtgtg

SEQ ID NO: 3081 - DNA, 201 bp, Homo sapiens
gataatgaggaaagtgaacaacctccagttccaggaactcccacactaaggaatcgtaccttctcagagtcttcggtttggtctcaacaatcttctagacyctccttgaaagatggtgctctggagagccaagatacagagaatgtcccagttacactatcagaggagaaccgttctgaaggaaaagttggttttcaggcc

SEQ ID NO: 3082 - DNA, 201 bp, Homo sapiens
atcagttgcagtacctcaaagctgcaagtcagattctgatattgaaagatggtaaaatggtgcagaaggggacttacactgagttcctaaaatctggtatrgattttggctcccttttaaagaaggataatgaggaaagtgaacaacctccagttccaggaactcccacactaaggaatcgtaccttctcagagtcttcgg

SEQ ID NO: 3083 - DNA, 201 bp, Homo sapiens; identical to SEQ ID NO: 3028

SEQ ID NO: 3084 - DNA, 201 bp, Homo sapiens; identical to SEQ ID NO: 3023

SEQ ID NO: 3085 - DNA, 201 bp, Homo sapiens
atccaagaactgatgagttaatacaaaaaaaaatccgggagaaatttgcccactgcaccgtgctaaccattgcacacagattgaacaccattattgacagygacaagataatggttttagattcaggaagactgaaagaatatgatgagccgtatgttttgctgcaaaataaagagagcctattttacaagatggtgcaac

SEQ ID NO: 3086 - DNA, 201 bp, Homo sapiens
acccttggttccccttggaatcattttcatttttcttcggcgatattttttggaaacgtcaagagatgtgaagcgcctggaatctacaactcggagtccaktgttttcccacttgtcatcttctctccaggggctctggaccatccgggcatacaaagcagaagagaggtgtcaggaactgtttgatgcacaccaggattt

SEQ ID NO: 3087 - DNA, 201 bp, Homo sapiens; identical to SEQ ID NO: 3036

SEQ ID NO: 3088 - DNA, 201 bp, Homo sapiens; identical to SEQ ID NO: 3031

SEQ ID NO: 3089 - DNA, 201 bp, Homo sapiens; identical to SEQ ID NO: 3021

SEQ ID NO: 3090 - DNA, 201 bp, Homo sapiens; identical to SEQ ID NO: 3020

SEQ ID NO: 3091 - DNA, 201 bp, Homo sapiens
atggttacaaacacttccaatggacagccctcgaccttaactattttcgagacagcactgtgaatccaaccaaaatgtcaagtccgttccgaaggcatttkccactagtttttggactatgtaaaccacattgtacttttttttactttggcaacaaatatttatacatacaagatgctagttcatttgaatatttctccc

SEQ ID NO: 3092 - DNA, 201 bp, Homo sapiens
atccaaatcagaggtgcaggccaccagttaaatgccgtctatcaggttttgtgccttaagagactacagagtcaaagctcatttttaaaggagtaggacaragttgtcacaggtttttgttgttgtttttattgcccccaaaattacatgttaatttccatttatatcagggattctatttacttgaagactgtgaagttg

SEQ ID NO: 3093 - DNA, 201 bp, Homo sapiens
agaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaagg

SEQ ID NO: 3094 - DNA, 201 bp, Homo sapiens
aggatagaagggcaatattttatcatatgttctaaaagagaaggaagagaaaatactactttctcaaaatggaagcccttaaaggtgctttgatactgaargacacaaatgtgaccgtccatcctcctttagagttgcatgacttggacacggtaactgttgcagttttagactcagcattgtgacacttcccaagaaggc

SEQ ID NO: 3095 - DNA, 201 bp, Homo sapiens
aatattttatcatatgttctaaaagagaaggaagagaaaatactactttctcaaaatggaagcccttaaaggtgctttgatactgaaggacacaaatgtgrccgtccatcctcctttagagttgcatgacttggacacggtaactgttgcagttttagactcagcattgtgacacttcccaagaaggccaaacctctaacc

SEQ ID NO: 3096 - DNA, 201 bp, Homo sapiens
cacttcccaagaaggccaaacctctaaccgacattcctgaaatacgtggcattattcttttttggatttctcatttatggaaggctaaccctctgttgacygtaagccttttggtttgggctgtattgaaatcctttctaaattgcatgaataggctctgctaacgtgatgagacaaactgaaaattattgcaagcattga

SEQ ID NO: 3097 - DNA, 201 bp, Homo sapiens
ctgttgactgtaagccttttggtttgggctgtattgaaatcctttctaaattgcatgaataggctctgctaacgtgatgagacaaactgaaaattattgcragcattgactataattatgcagtacgttctcaggatgcatccaggggttcattttcatgagcctgtccaggttagtttactcctgaccactaatagcatt

SEQ ID NO: 3098 - DNA, 201 bp, Homo sapiens
atatgttgagttcagtttactaaaggttttactattatggtttgaagtggagtctcatgacctctcagaataaggtgtcacctccctgaaattgcatataygtatatagacatgcacacgtgtgcatttgtttgtatacatatatttgtccttcgtatagcaagttttttgctcatcagcagagagcaaccgatgttttat

SEQ ID NO: 3099 - DNA, 201 bp, Homo sapiens
ctaaaggttttactattatggtttgaagtggagtctcatgacctctcagaataaggtgtcacctccctgaaattgcatatatgtatatagacatgcacacrtgtgcatttgtttgtatacatatatttgtccttcgtatagcaagttttttgctcatcagcagagagcaaccgatgttttattgagtgaagccttaaaaag

SEQ ID NO: 3100 - DNA, 201 bp, Homo sapiens
ataaggtgtcacctccctgaaattgcatatatgtatatagacatgcacacgtgtgcatttgtttgtatacatatatttgtccttcgtatagcaagtttttygctcatcagcagagagcaaccgatgttttattgagtgaagccttaaaaagcacacaccacacacagctaactgccaaaatacattgaccgtagtagctgt

SEQ ID NO: 3101 - DNA, 201 bp, Homo sapiens
attgcatatatgtatatagacatgcacacgtgtgcatttgtttgtatacatatatttgtccttcgtatagcaagttttttgctcatcagcagagagcaacmgatgttttattgagtgaagccttaaaaagcacacaccacacacagctaactgccaaaatacattgaccgtagtagctgttcaactcctagtacttagaaa

SEQ ID NO: 3102 - DNA, 201 bp, Homo sapiens
acttagaaatacacgtatggttaatgttcagtccaacaaaccacacacagtaaatgtttattaatagtcatggttcgtattttaggtgactgaaattgcawcagtgatcataatgaggtttgttaaaacgatagctatattcaaaatgtctatatgtttatttggacttttgaggttaaagacagtcatataaacgtcctg

SEQ ID NO: 3103 - DNA, 201 bp, Homo sapiens
cagtccaacaaaccacacacagtaaatgtttattaatagtcatggttcgtattttaggtgactgaaattgcaacagtgatcataatgaggtttgttaaaaygatagctatattcaaaatgtctatatgtttatttggacttttgaggttaaagacagtcatataaacgtcctgtttctgttttaatgttatcatagaattt

SEQ ID NO: 3104 - DNA, 146 bp, Homo sapiens
gatagctatattcaaaatgtctatatgtttatttggacttttgaggttaaagacagtcatataaacgtcctgtttctgttttaatgttatcatagaatttyttaatgaaactaaattcaattgaaataaatgatagttttcatctc

SEQ ID NO: 3105 - DNA, 173 bp, Homo sapiens
gcgcccgccccgcccggcaagatgctgcccgtgtaccaggaggtgaagcccaacccgctgcaggacgcgaacmtctgctcacgcgtgttcttctggtctcccccgcctctttcttggaaggacacttgccattggatttaggacccacttggataatccaggatgatgtcttc

SEQ ID NO: 3106 - DNA, 201 bp, Homo sapiens; identical to SEQ ID NO: 3019

SEQ ID NO: 3107 - DNA, 201 bp, Homo sapiens; identical to SEQ ID NO: 3020

SEQ ID NO: 3108 - DNA, 201 bp, Homo sapiens; identical to SEQ ID NO: 3021

SEQ ID NO: 3109 - DNA, 201 bp, Homo sapiens; identical to SEQ ID NO: 3022

SEQ ID NO: 3110 - DNA, 201 bp, Homo sapiens; identical to SEQ ID NO: 3023

SEQ ID NO: 3111 - DNA, 201 bp, Homo sapiens; identical to SEQ ID NO: 3024

SEQ ID NO: 3112 - DNA, 201 bp, Homo sapiens; identical to SEQ ID NO: 3025

SEQ ID NO: 3113 - DNA, 201 bp, Homo sapiens; identical to SEQ ID NO: 3026

SEQ ID NO: 3114 - DNA, 201 bp, Homo sapiens; identical to SEQ ID NO: 3027

SEQ ID NO: 3115 - DNA, 201 bp, Homo sapiens; identical to SEQ ID NO: 3028

SEQ ID NO: 3116 - DNA, 201 bp, Homo sapiens; identical to SEQ ID NO: 3029

SEQ ID NO: 3117 - DNA, 201 bp, Homo sapiens; identical to SEQ ID NO: 3030

SEQ ID NO: 3118 - DNA, 201 bp, Homo sapiens; identical to SEQ ID NO: 3031

SEQ ID NO: 3119 - DNA, 201 bp, Homo sapiens; identical to SEQ ID NO: 3032

SEQ ID NO: 3120 - DNA, 201 bp, Homo sapiens; identical to SEQ ID NO: 3033

SEQ ID NO: 3121 - DNA, 201 bp, Homo sapiens; identical to SEQ ID NO: 3034

SEQ ID NO: 3122 - DNA, 201 bp, Homo sapiens; identical to SEQ ID NO: 3035

SEQ ID NO: 3123 - DNA, 201 bp, Homo sapiens; identical to SEQ ID NO: 3036

SEQ ID NO: 3124 - DNA, 201 bp, Homo sapiens; identical to SEQ ID NO: 3037

SEQ ID NO: 3125 - DNA, 201 bp, Homo sapiens; identical to SEQ ID NO: 3038

SEQ ID NO: 3126 - DNA, 201 bp, Homo sapiens; identical to SEQ ID NO: 3039

SEQ ID NO: 3127 - DNA, 195 bp, Homo sapiens; identical to SEQ ID NO: 3040

SEQ ID NO: 3128 - DNA, 201 bp, Homo sapiens
ctgctgaccctgaggacatctgctggaagaacctctctatccagggcctccgctggtggctacagtggctgggcatcaacttcaccctcttcctggggctrtttttcctgaccacaccctccatcatcctgtccaccatggacaagtttaatgtcaccaaacccatccatgcgctgaataacccgatcatcagccagttct

SEQ ID NO: 3129 - DNA, 201 bp, Homo sapiens
ggacagcactgtctccgcagcagcagcagcagcagacctatggtgccatccacaacatcagcgggactatccctggacagtgcttggcgcagagcgccacrggcagtgtggctgctgccccccaggaggcctgaggctgggtctcactgctctgaaaagacacaaccagaatggcctggggctcaggcccttggctgagtg

SEQ ID NO: 3130 - DNA, 201 bp, Homo sapiens
ccatccactacctgtccttccagaggcacatcatcttcctgttggtggtggtcagctttttgtccctgtgtgtcatcctgcctgtcaacctctcaggggayttgctggacaaagacccgtatagttttgggaggacaacaatagcaaacctacagactgacaatgacctcctttggctgcacaccatctttgctgtcattt

SEQ ID NO: 3131 - DNA, 201 bp, Homo sapiens
gcttcaagcacctcagccctctgaactacaaaacagaagagcctgcaagtgacaaaggaagtgaggcagaggcccacatgcccccaccgttcacaccctaygtgcctcggattctgaacggcttggcctcggagaggacagcactgtctccgcagcagcagcagcagcagacctatggtgccatccacaacatcagcggga

SEQ ID NO: 3132 - DNA, 201 bp, Homo sapiens
gaggtggctggggctgcttttgcctttgccagagacagctccaactgaggacctctccaacgggcccatccacagtccttccttcccctagtgtctgggargacaggcgcgatgatggactccccgttcctggagctgtggcagtccaaggcagtgtccatcagggagcagctgggactcggggaccggcccaacgactcc

SEQ ID NO: 3133 - DNA, 201 bp, Homo sapiens
caagacggctgctgaccgcaggaatgtcaagcagaaccaggccttccagtacgagtttggagccatgtatgcatggatgctgtgtgtcttcactgtcatcrtggcctacagcatcacttgtcccatcatcgcgccatttggcctcatctacatcctgctcaagcacatggtggaccggcacaacctctacttcgtctacct

SEQ ID NO: 3134 - DNA, 201 bp, Homo sapiens
tggtgctgatcctgccctccctgggtctcaccagtctagattttttcttccggtggctctttgacaaaacttcctcggaggcctccatcaggttggagtgygtcttcctgcctgaccagggtgccttctttgtgaactatgtcatcgcctcggccttcatcggcaatggcatggagctgctgcggctgccaggtctcatcc

SEQ ID NO: 3135 - DNA, 201 bp, Homo sapiens
caaagacccgtatagttttgggaggacaacaatagcaaacctacagactgacaatgacctcctttggctgcacaccatctttgctgtcatttacctcttcytcactgtgggtttcatgcggcaccacactcagtccattaagtacaaagaggagaacctggtgaggcggaccctgttcatcacaggactccccagagatgc

SEQ ID NO: 3136 - DNA, 201 bp, Homo sapiens
ggtggctctttgacaaaacttcctcggaggcctccatcaggttggagtgcgtcttcctgcctgaccagggtgccttctttgtgaactatgtcatcgcctcrgccttcatcggcaatggcatggagctgctgcggctgccaggtctcatcctctataccttccgcatgatcatggccaagacggctgctgaccgcaggaatg

SEQ ID NO: 3137 - DNA, 201 bp, Homo sapiens
tcacaggactccccagagatgccaggaaggagactgtggagagccacttccgggacgcgtatcccacgtgtgaggtggttgatgtgcagctgtgctacaaygtggccaaactgatctacctgtgcaaggagaaaaagaagactgagaagagcctgacctattacacaaacctgcaggtgaagacaggccagcggaccctca

SEQ ID NO: 3138 - DNA, 201 bp, Homo sapiens
ggaaggcctcctcccttctgagcacacacacaaccgataaccaaagagatgctgcagtccaggtctgaggtcccgctggcatccagctccctgctccatgrccagtccctccccagcccagcagtccctccaggctacatccaggaaactatgaagaactttgagatgggcaagacaattcctgggtgtcttctggacaag

SEQ ID NO: 3139 - DNA, 201 bp, Homo sapiens; identical to SEQ ID NO: 3128

SEQ ID NO: 3140 - DNA, 201 bp, Homo sapiens; identical to SEQ ID NO: 3129

SEQ ID NO: 3141 - DNA, 201 bp, Homo sapiens; identical to SEQ ID NO: 3130

SEQ ID NO: 3142 - DNA, 201 bp, Homo sapiens; identical to SEQ ID NO: 3131

SEQ ID NO: 3143 - DNA, 201 bp, Homo sapiens; identical to SEQ ID NO: 3132

SEQ ID NO: 3144 - DNA, 201 bp, Homo sapiens; identical to SEQ ID NO: 3133

SEQ ID NO: 3145 - DNA, 201 bp, Homo sapiens; identical to SEQ ID NO: 3134

SEQ ID NO: 3146 - DNA, 201 bp, Homo sapiens; identical to SEQ ID NO: 3135

SEQ ID NO: 3147 - DNA, 201 bp, Homo sapiens; identical to SEQ ID NO: 3136

SEQ ID NO: 3148 - DNA, 201 bp, Homo sapiens; identical to SEQ ID NO: 3137

SEQ ID NO: 3149 - DNA, 201 bp, Homo sapiens
ggaaggcctcctcccttctgagcacacacacaaccgataaccaaagagatgctgcagtccaggtctgaggtcccgctggcatccagctccctgctccatgrccagtccctccccagcccagcagtccctccaggctacatccaggagtaagctatggggaacaggttgggaggtggccagtgctcctgccagctgtgcaca

SEQ ID NO: 3150 - DNA, 201 bp, Homo sapiens
gctgggtcagggttaccccatagcaggcagggacaaggaccactcataatatgcccattggaccacagttaagatccagcctctctcacctcttcagggcygagtgcatgagtctgcacctccaggcaggctctgtgcagtactcaccccctccgtctgctccctccaaggtgtgggggtgggcagtgctcagggcctcct

SEQ ID NO: 3151 - DNA, 201 bp, Homo sapiens
gggggtgggcagtgctcagggcctcctcggagccaaaggacagcatggtcggcacagaggaaggggtacctgggctgggtgcagggccatcccactgcccktgagctgtggctctggcaggaaggaggggcagcccatccctcttctccctcctggggattctggggaatgggatgcaacttaagacttctgcctgagaag

SEQ ID NO: 3152 - DNA, 201 bp, Homo sapiens
tcctggggattctggggaatgggatgcaacttaagacttctgcctgagaagcctcctccctgctgcctccagggggcaccaaggcacaagcctgtgcagtwggggcgggatgggggtgtggaagagcaggtccaggctcctagcacaactggcctggggccttggcacctctgtaggccctgcctgtgcctgtccgctggc

SEQ ID NO: 3153 - DNA, 201 bp, Homo sapiens
tctgtaggccctgcctgtgcctgtccgctggcctggggggcctgggcttatctgggccttctcactcagggactctcttgacgctgacttgcccccgcagyggtggccagtgctgcctctgctccaagctgcccctgcgctgggaggggtgggggcggtgccattggtctggtgcagcatagccctggccagtggcctcat

SEQ ID NO: 3154 - DNA, 201 bp, Homo sapiens
gtaggccctgcctgtgcctgtccgctggcctggggggcctgggcttatctgggccttctcactcagggactctcttgacgctgacttgcccccgcagtggyggccagtgctgcctctgctccaagctgcccctgcgctgggaggggtgggggcggtgccattggtctggtgcagcatagccctggccagtggcctcatccc

SEQ ID NO: 3155 - DNA, 201 bp, Homo sapiens
cccagcgcctcgcgtcaaggtcccaagcctggaccacctgcagcaacggtcgcacgacaaacctcgcgggtctcaccagcgccgccatgttccctgagacycgggctgcgtcacgaaagcgcgccgtcggcggctagtgacgtcacggcccgtggcgcccttcgtggactgggctgtacggtgcgcgtgacggctgcgtgc

SEQ ID NO: 3156 - DNA, 201 bp, Homo sapiens
ctcctcgagcggttgtttctctcgttgctcctgggcactggcctcagatggtgccttgcggggctgcttcccaggagcgcgcttctgttccaccacctctycggaaggaaacaccactttcactgggctccgccgcagcgcccggacccagcgcctcgcgtcaaggtcccaagcctggaccacctgcagcaacggtcgcac

SEQ ID NO: 3157 - DNA, 201 bp, Homo sapiens
accactttcactgggctccgccgcagcgcccggacccagcgcctcgcgtcaaggtcccaagcctggaccacctgcagcaacggtcgcacgacaaacctcgmgggtctcaccagcgccgccatgttccctgagacccgggctgcgtcacgaaagcgcgccgtcggcggctagtgacgtcacggcccgtggcgcccttcgtgg

SEQ ID NO: 3158 - DNA, 201 bp, Homo sapiens
tatggcgtcggagactacaagcttggcaatgactttatgggaatcacgctcgcttctagccaggctgtcagcaacgccaggaagctggagtggccactgayggaagttgcagaaggtgtttttgaaaccgaggccccgggaggatataagttctatttgcagaatcgcagtctgcctcagtcagatcctgtattaaaagta

SEQ ID NO: 3159 - DNA, 201 bp, Homo sapiens; identical to SEQ ID NO: 3155

SEQ ID NO: 3160 - DNA, 201 bp, Homo sapiens; identical to SEQ ID NO: 3156

SEQ ID NO: 3161 - DNA, 201 bp, Homo sapiens; identical to SEQ ID NO: 3157

SEQ ID NO: 3162 - DNA, 201 bp, Homo sapiens; identical to SEQ ID NO: 3158

SEQ ID NO: 3163 - DNA, 201 bp, Homo sapiens
tgatgaaaagggagaaccagaagattctgactcccctggtgagcctggacaccccagggaaagcaacagtacaggtggtcattctggccgaccctgacggwcatgaaatttgctttgtcggggatgaagcatttcgagaactttctaagatggatccagagggaagcaaattgttggatgatgcaatggcagcagataaaa

SEQ ID NO: 3164 - DNA, 201 bp, Homo sapiens; identical to SEQ ID NO: 3155

SEQ ID NO: 3165 - DNA, 201 bp, Homo sapiens; identical to SEQ ID NO: 3156

SEQ ID NO: 3166 - DNA, 201 bp, Homo sapiens; identical to SEQ ID NO: 3157

SEQ ID NO: 3167 - DNA, 201 bp, Homo sapiens; identical to SEQ ID NO: 3158

SEQ ID NO: 3168 - DNA, 201 bp, Homo sapiens; identical to SEQ ID NO: 3163

SEQ ID NO: 3169 - DNA, 201 bp, Homo sapiens; identical to SEQ ID NO: 3155

SEQ ID NO: 3170 - DNA, 201 bp, Homo sapiens; identical to SEQ ID NO: 3156

SEQ ID NO: 3171 - DNA, 201 bp, Homo sapiens; identical to SEQ ID NO: 3157

SEQ ID NO: 3172 - DNA, 201 bp, Homo sapiens; identical to SEQ ID NO: 3158

SEQ ID NO: 3173 - DNA, 201 bp, Homo sapiens; identical to SEQ ID NO: 3163

SEQ ID NO: 3174 - DNA, 201 bp, Homo sapiens; identical to SEQ ID NO: 3158

SEQ ID NO: 3175 - DNA, 201 bp, Homo sapiens; identical to SEQ ID NO: 3163

SEQ ID NO: 3176 - DNA, 201 bp, Homo sapiens; identical to SEQ ID NO: 3155

SEQ ID NO: 3177 - DNA, 201 bp, Homo sapiens; identical to SEQ ID NO: 3156

SEQ ID NO: 3178 - DNA, 201 bp, Homo sapiens; identical to SEQ ID NO: 3157

SEQ ID NO: 3179 - DNA, 201 bp, Homo sapiens; identical to SEQ ID NO: 3158

SEQ ID NO: 3180 - DNA, 201 bp, Homo sapiens; identical to SEQ ID NO: 3163

SEQ ID NO: 3181 - DNA, 201 bp, Homo sapiens
tgccaaacacaataaacccaaagcttcaggttaacggaagacatgatgcagagcaagcctctgtgattcctgcccagcacctgtgaggcctgacgtgtcarttcccaataaatgctcttctgatttgtttcccgtacaggcaaggaggcttgggtagtgcagatttgtgtatttcaatctttgaaagctctgatgtaattt

SEQ ID NO: 3182 - DNA, 114 bp, Homo sapiens
gtgacgcagcccgrgtctcagggaacatggcggcgctggtgagacccgcgaggtttgtcgtgcgaccgttgctgcaggtggtccaggcttgggaccttgacgcgaggcgctggg

SEQ ID NO: 3183 - DNA, 201 bp, Homo sapiens
gtgcgaccgttgctgcaggtggtccaggcttgggaccttgacgcgaggcgctgggtccgggcgctgcggcggagcccagtgaaagtggtgtttccttccgragaggtggtggaacagaagcgcgctcctgggaagcagccccgcaaggcaccatctgaggccagtgcccaggagcaacgagagaaacaaccgctcgaggag

SEQ ID NO: 3184 - DNA, 148 bp, Homo sapiens
gtgacgcagcccgggtctcagggaacatggcggcgctggtgagaccckcgaggtttgtcgtgcgaccgttgctgcaggtggtccaggcttgggaccttgacgcgaggcgctgggtccgggcgctgcggcggagcccagtgaaagtggt

SEQ ID NO: 3185 - DNA, 201 bp, Homo sapiens
ttatgcccaggctgagatgtctaataaagctagtgaccatggctgggtgtgtgatcaacgagtgatgaagtttcacaagtatgaggaagaggaagatgtasaaaccggagccagtcaagattggctgcctcatgttgaggttcagagttacgactcggactggacagaggcgccggcagctgtggtgattggcggggagac

SEQ ID NO: 3186 - DNA, 201 bp, Homo sapiens
gctgcagcaaagtgttactcaccaaaggctgtgtggatgcctgggagcccaaagtgctccgggcgggtatgggcgcacatttccggatgcccattatcaayaatctggaatgggaaaccgtgcccaattacctgccccctgacactcgggtctatgtggctgacaactgtggcctttatgcccaggctgagatgtctaata

SEQ ID NO: 3187 - DNA, 201 bp, Homo sapiens
aacttcatggtctaccaaccaaccccgtgggaggcagcctcagactcgatgaaacgactacaaagtgccatgacagaaggtggtgtggttctacgggaacytcagagaatctatgaataaatggaagcattaattgttttgaacatgtaaatataaatctgtcagccactacagccatcaaaagagagcatctggaagaac

SEQ ID NO: 3188 - DNA, 198 bp, Homo sapiens
ggagctggggtgtaactggaggggcgggcccttctccaagttagagttggggttctgagcgagtcgtgcgttttaggtttagtgtcttttccttgtcyctgctcggggagcgtgaggcagatcggccggctttgctccaggcctcaggagtggtgcaggttcgcagccctgtcaaccagctccgagccggcagcgaaa

SEQ ID NO: 3189 - DNA, 201 bp, Homo sapiens
agccagcttggaagttttacagcaataatgttgcagtggaatattatttgtagttaaggtcatcctcctcccctttctgtttttttaaatcaagaactacrttctgcccctctcttgggcttcagaagcatctaagaaaagcagtcatcaattataattaactttcaaagggcaagtcagaagttgtttataaattacaaa

SEQ ID NO: 3190 - DNA, 201 bp, Homo sapiens
gtggagcacatatgaggttgatgtaaagcacttattactgtgtctagttcatggcgagtgatctcagtgaatgacagttgtttgctgctcggagtgtgggktgttttttaaaataggaaatgtcagtatcaatctaatattatagaacagtcagtatgtgaaaatgaaaggaccaaatgccaacctcacttggactcttgg

SEQ ID NO: 3191 - DNA, 201 bp, Homo sapiens
gtgtctagttcatggcgagtgatctcagtgaatgacagttgtttgctgctcggagtgtggggtgttttttaaaataggaaatgtcagtatcaatctaataytatagaacagtcagtatgtgaaaatgaaaggaccaaatgccaacctcacttggactcttggttcccaacagtaagagaaacaaatttgaaagaggaagga

SEQ ID NO: 3192 - DNA, 201 bp, Homo sapiens
cgagtgatctcagtgaatgacagttgtttgctgctcggagtgtggggtgttttttaaaataggaaatgtcagtatcaatctaatattatagaacagtcagwatgtgaaaatgaaaggaccaaatgccaacctcacttggactcttggttcccaacagtaagagaaacaaatttgaaagaggaaggaggtggcatcaggagc

SEQ ID NO: 3193 - DNA, 201 bp, Homo sapiens
tggtcttgggcgtagctacgaggtggttggtgggctccagggcctgcgtgcccctcgacgtgagcgatgattggcggtgcaggataacagatcgccttctyggccactcagtggcaggggacttgctacttccgggtcggcggcgtctggcgtggagagtttggggatctacagcagccaaaggcttgtccctgactttat

SEQ ID NO: 3194 - DNA, 201 bp, Homo sapiens
ggcggcgtctggcgtggagagtttggggatctacagcagccaaaggcttgtccctgactttatatggctgcgcctggcgagcgactgagtcgtccgtgagraaaaagaggcgaggcttttccgagatcgtctcagcgatggcgcttcggtcgcagttttgggggttctcggtttgcaggaaccctgggtgcaggttcgcag

SEQ ID NO: 3195 - DNA, 201 bp, Homo sapiens
cccggacttaagcaacaagcgtggtcttgggcgtagctacgaggtggttggtgggctccagggcctgcgtgcccctcgacgtgagcgatgattggcggtgmaggataacagatcgccttcttggccactcagtggcaggggacttgctacttccgggtcggcggcgtctggcgtggagagtttggggatctacagcagcca

SEQ ID NO: 3196 - DNA, 201 bp, Homo sapiens; identical to SEQ ID NO: 3187

SEQ ID NO: 3197 - DNA, 151 bp, Homo sapiens
tggggttctgagcgagtcgtgcgttttaggtttagtgtcttttccttgtcyctgctcggggagcgtgaggcagatcggccggctttgctccaggcctcaggagtgtaagtttaagggcgcgaacctgggtgggacggggcagtttttccag

SEQ ID NO: 3198 - DNA, 201 bp, Homo sapiens
gggtgggacggggcagtttttccagcgggccatacgggaaaatttttggttcgaggaagacaaccaccctttttaaggagaaaactgcatcttgccctgcsttattcctacgcggtgcccaggtggggtgtgtgtggaccagtcaatgaccgcccaagctctccgagtagaaaacccaaacatggttttgtggggtgtgtg

SEQ ID NO: 3199 - DNA, 201 bp, Homo sapiens
ggggtgtgtgtggaccagtcaatgaccgcccaagctctccgagtagaaaacccaaacatggttttgtggggtgtgtgcctttgaccccggacttaagcaamaagcgtggtcttgggcgtagctacgaggtggttggtgggctccagggcctgcgtgcccctcgacgtgagcgatgattggcggtgcaggataacagatcgc

SEQ ID NO: 3200 - DNA, 201 bp, Homo sapiens
ggcctgcgtgcccctcgacgtgagcgatgattggcggtgcaggataacagatcgccttcttggccactcagtggcaggggacttgctacttccgggtcggyggcgtctggcgtggagagtttggggatctacagcagccaaaggcttgtccctgactttatatggctgcgcctggcgagcgactgagtcgtccgtgaggaa

SEQ ID NO: 3201 - DNA, 201 bp, Homo sapiens
ctgactttatatggctgcgcctggcgagcgactgagtcgtccgtgaggaaaaagaggcgaggcttttccgagatcgtctcagcgatggcgcttcggtcgcrgttttgggggttctcggtttgcaggaaccctgggtgcaggttcgcagccctgtcaaccagctccgagccggcagcgaaacctgaagtggaccctgtggaa

SEQ ID NO: 3202 - DNA, 201 bp, Homo sapiens
gaccccggacttaagcaacaagcgtggtcttgggcgtagctacgaggtggttggtgggctccagggcctgcgtgcccctcgacgtgagcgatgattggcgrtgcaggataacagatcgccttcttggccactcagtggcaggggacttgctacttccgggtcggcggcgtctggcgtggagagtttggggatctacagcag

SEQ ID NO: 3203 - DNA, 201 bp, Homo sapiens
tttggttcgaggaagacaaccaccctttttaaggagaaaactgcatcttgccctgccttattcctacgcggtgcccaggtggggtgtgtgtggaccagtcratgaccgcccaagctctccgagtagaaaacccaaacatggttttgtggggtgtgtgcctttgaccccggacttaagcaacaagcgtggtcttgggcgtag

SEQ ID NO: 3204 - DNA, 201 bp, Homo sapiens
agtggcaggggacttgctacttccgggtcggcggcgtctggcgtggagagtttggggatctacagcagccaaaggcttgtccctgactttatatggctgckcctggcgagcgactgagtcgtccgtgaggaaaaagaggcgaggcttttccgagatcgtctcagcgatggcgcttcggtcgcagttttgggggttctcggt

SEQ ID NO: 3205 - DNA, 201 bp, Homo sapiens; identical to SEQ ID NO: 3189

SEQ ID NO: 3206 - DNA, 201 bp, Homo sapiens; identical to SEQ ID NO: 3190

SEQ ID NO: 3207 - DNA, 201 bp, Homo sapiens; identical to SEQ ID NO: 3191

SEQ ID NO: 3208 - DNA, 201 bp, Homo sapiens; identical to SEQ ID NO: 3192

SEQ ID NO: 3209 - DNA, 201 bp, Homo sapiens
aatattgaaggaggggctatagccttgggccaccctcttggagcatctggctgtcgaattcttgtgaccctgttacacacactggagagaatgggcagaartcgtggtgttgcagccctgtgcattgggggtgggatgggaatagcaatgtgtgttcagagagaatgaattgcttaaactttgaacaacctcaatttcttt

SEQ ID NO: 3210 - DNA, 201 bp, Homo sapiens
gaataggaccaattccagccataaagcaagctgttacaaaagcaggttggtcactggaagatgttgacatatttgaaatcaatgaagcctttgcagctgtytctgctgcaatagttaaagaacttggattaaacccagagaaggtcaatattgaaggaggggctatagccttgggccaccctcttggagcatctggctgtc

SEQ ID NO: 3211 - DNA, 201 bp, Homo sapiens
cgtgggattccagtcctgagctgaacgagagataagtctttgtcaccccccagtctttactgtttcgagaaaccctaagattttttaaaaaaaagcccaaracgtcaagtcggggaactccaacattggggtgtccagaaacactggggtttcaggcgctctgtaaatgcgtccgaggtccgcggttctgcccgcaagccc

SEQ ID NO: 3212 - DNA, 201 bp, Homo sapiens
ccaagacgtcaagtcggggaactccaacattggggtgtccagaaacactggggtttcaggcgctctgtaaatgcgtccgaggtccgcggttctgcccgcargcccagaccccggcctcacttccgccccgcgccccgcgccccggcctcacgtcccgcccgcggcaggcctgtgggctgcgaggaggagctttgcctagct

SEQ ID NO: 3213 - DNA, 201 bp, Homo sapiens
ataggaccaattccagccataaagcaagctgttacaaaagcaggttggtcactggaagatgttgacatatttgaaatcaatgaagcctttgcagctgtctytgctgcaatagttaaagaacttggattaaacccagagaaggtcaatattgaaggaggggctatagccttgggccaccctcttggagcatctggctgtcga

SEQ ID NO: 3214 - DNA, 201 bp, Homo sapiens
caggacaaggttgcagttctgtcccagaacaggacagagaatgcacagaaagctggccattttgacaaagagattgtaccagttttggtgtcaactagaaraggtcttattgaagttaaaacagatgagtttcctcgccatgggagcaacatagaagccatgtccaagctaaagccttactttcttactgatggaacggga

SEQ ID NO: 3215 - DNA, 201 bp, Homo sapiens
gcccctcacgcgagcgaatgactggcgccaggagaaacgcataggacctcccgaagccgccgagagcaaaaggacccatcagagctgtgctgagacccgcygcgggccgggctcgcactcgagattctcgcccgtgggattccagtcctgagctgaacgagagataagtctttgtcaccccccagtctttactgtttcgag

SEQ ID NO: 3216 - DNA, 201 bp, Homo sapiens
ctgatggaacgggaacagtcaccccagccaatgcttcaggaataaatgatggtgctgcagctgtcgttcttatgaagaagtcagaagctgataaacgtggrcttacacctttagcacggatagtttcctggtcccaagtgggtgtggagccttccattatgggaataggaccaattccagccataaagcaagctgttacaa

SEQ ID NO: 3217 - DNA, 201 bp, Homo sapiens
tagaagccatgtccaagctaaagccttactttcttactgatggaacgggaacagtcaccccagccaatgcttcaggaataaatgatggtgctgcagctgtygttcttatgaagaagtcagaagctgataaacgtgggcttacacctttagcacggatagtttcctggtcccaagtgggtgtggagccttccattatgggaa

SEQ ID NO: 3218 - DNA, 201 bp, Homo sapiens
tgaaatcagaggaccaaagtacagatggaaaccatttcctacatcacaaaaacccaagtttacagcttgtactttactttaatgtgtaatactcaactcamggtacaagacaattgcatttaacattgttataaataaaaggaacatcagatcaatcattaagggctccagagtgaacagcatcttcataacttccatgtt

SEQ ID NO: 3219 - DNA, 201 bp, Homo sapiens
tacagatggaaaccatttcctacatcacaaaaacccaagtttacagcttgtactttactttaatgtgtaatactcaactcaaggtacaagacaattgcatytaacattgttataaataaaaggaacatcagatcaatcattaagggctccagagtgaacagcatcttcataacttccatgtttatcatctttactttctgg

SEQ ID NO: 3220 - DNA, 201 bp, Homo sapiens
tttacagcttgtactttactttaatgtgtaatactcaactcaaggtacaagacaattgcatttaacattgttataaataaaaggaacatcagatcaatcawtaagggctccagagtgaacagcatcttcataacttccatgtttatcatctttactttctggcattttagatttttacgttctgggttaacctgggcctca

SEQ ID NO: 3221 - DNA, 201 bp, Homo sapiens
ttacagcttgtactttactttaatgtgtaatactcaactcaaggtacaagacaattgcatttaacattgttataaataaaaggaacatcagatcaatcatwaagggctccagagtgaacagcatcttcataacttccatgtttatcatctttactttctggcattttagatttttacgttctgggttaacctgggcctcat

SEQ ID NO: 3222 - DNA, 201 bp, Homo sapiens; identical to SEQ ID NO: 3209

SEQ ID NO: 3223 - DNA, 201 bp, Homo sapiens; identical to SEQ ID NO: 3210

SEQ ID NO: 3224 - DNA, 201 bp, Homo sapiens; identical to SEQ ID NO: 3211

SEQ ID NO: 3225 - DNA, 201 bp, Homo sapiens; identical to SEQ ID NO: 3212

SEQ ID NO: 3226 - DNA, 201 bp, Homo sapiens; identical to SEQ ID NO: 3213

SEQ ID NO: 3227 - DNA, 201 bp, Homo sapiens; identical to SEQ ID NO: 3214

SEQ ID NO: 3228 - DNA, 201 bp, Homo sapiens; identical to SEQ ID NO: 3215

SEQ ID NO: 3229 - DNA, 201 bp, Homo sapiens; identical to SEQ ID NO: 3216

SEQ ID NO: 3230 - DNA, 201 bp, Homo sapiens; identical to SEQ ID NO: 3217

SEQ ID NO: 3231 - DNA, 201 bp, Homo sapiens; identical to SEQ ID NO: 3218

SEQ ID NO: 3232 - DNA, 201 bp, Homo sapiens; identical to SEQ ID NO: 3219

SEQ ID NO: 3233 - DNA, 194 bp, Homo sapiens
tttacagcttgtactttactttaatgtgtaatactcaactcaaggtacaagacaattgcatttaacattgttataaataaaaggaacatcagatcaatcawtaagggctccagagtgaacagcatcttcataacttccatgtttatcatctttactttctggatgtaatttaataagatcatcaattcgaagaa

SEQ ID NO: 3234 - DNA, 193 bp, Homo sapiens
ttacagcttgtactttactttaatgtgtaatactcaactcaaggtacaagacaattgcatttaacattgttataaataaaaggaacatcagatcaatcatwaagggctccagagtgaacagcatcttcataacttccatgtttatcatctttactttctggatgtaatttaataagatcatcaattcgaagaa

SEQ ID NO: 3235 - DNA, 201 bp, Homo sapiens; identical to SEQ ID NO: 3209

SEQ ID NO: 3236 - DNA, 201 bp, Homo sapiens; identical to SEQ ID NO: 3210

SEQ ID NO: 3237 - DNA, 201 bp, Homo sapiens; identical to SEQ ID NO: 3213

SEQ ID NO: 3238 - DNA, 201 bp, Homo sapiens; identical to SEQ ID NO: 3214

SEQ ID NO: 3239 - DNA, 201 bp, Homo sapiens; identical to SEQ ID NO: 3216

SEQ ID NO: 3240 - DNA, 201 bp, Homo sapiens; identical to SEQ ID NO: 3217

SEQ ID NO: 3241 - DNA, 201 bp, Homo sapiens; identical to SEQ ID NO: 3218

SEQ ID NO: 3242 - DNA, 201 bp, Homo sapiens; identical to SEQ ID NO: 3219

SEQ ID NO: 3243 - DNA, 194 bp, Homo sapiens; identical to SEQ ID NO: 3233

SEQ ID NO: 3244 - DNA, 193 bp, Homo sapiens; identical to SEQ ID NO: 3234

SEQ ID NO: 3245 - DNA, 201 bp, Homo sapiens
tttgagcaatggtaaacctcgagacaacaaacaagcaggggtgtttgaaccaaccatagttaaagttaagagtttgaaatttgcaacagaagctgcaatcmccattcttcgaattgatgatcttattaaattacatccagaaagtaaagatgataaacatggaagttatgaagatgctgttcactctggagcccttaatga

SEQ ID NO: 3246 - DNA, 201 bp, Homo sapiens
atcaccattcttcgaattgatgatcttattaaattacatccagaaagtaaagatgataaacatggaagttatgaagatgctgttcactctggagcccttawtgattgatctgatgttccttttatttataacaatgttaaatgcaattgtcttgtaccttgagttgagtattacacattaaagtaaagtacaagctgtaaa

SEQ ID NO: 3247 - DNA, 201 bp, Homo sapiens
aatcaccattcttcgaattgatgatcttattaaattacatccagaaagtaaagatgataaacatggaagttatgaagatgctgttcactctggagcccttwatgattgatctgatgttccttttatttataacaatgttaaatgcaattgtcttgtaccttgagttgagtattacacattaaagtaaagtacaagctgtaa

SEQ ID NO: 3248 - DNA, 201 bp, Homo sapiens
ccagaaagtaaagatgataaacatggaagttatgaagatgctgttcactctggagcccttaatgattgatctgatgttccttttatttataacaatgttaratgcaattgtcttgtaccttgagttgagtattacacattaaagtaaagtacaagctgtaaacttgggtttttgtgatgtaggaaatggtttccatctgta

SEQ ID NO: 3249 - DNA, 201 bp, Homo sapiens
aacatggaagttatgaagatgctgttcactctggagcccttaatgattgatctgatgttccttttatttataacaatgttaaatgcaattgtcttgtaccktgagttgagtattacacattaaagtaaagtacaagctgtaaacttgggtttttgtgatgtaggaaatggtttccatctgtactttggtcctctgatttca

SEQ ID NO: 3250 - DNA, 201 bp, Homo sapiens
aaagaaattgaggttgttcaaagtttaagcaattcattctctctgaacacacattgctattcccatcccacccccaatgcacagggctgcaacaccacgayttctgcccattctctccagtgtgtgtaacagggtcacaagaattcgacagccagatgctccaagagggtggcccaaggctatagcccctccttcaatatt

SEQ ID NO: 3251 - DNA, 201 bp, Homo sapiens
aaggctatagcccctccttcaatattgacggtcctattcccataatggaaggctccacacccacttgggaccaggaaactatccgtgctaaaggtgtaagyccacgtttatcagcttctgacttcttcataagaacgacagctgcagcaccatcatttattcctgaagcattggctggggtgactgttcccgttccatcag

SEQ ID NO: 3252 - DNA, 201 bp, Homo sapiens
ttcccataatggaaggctccacacccacttgggaccaggaaactatccgtgctaaaggtgtaagcccacgtttatcagcttctgacttcttcataagaacracagctgcagcaccatcatttattcctgaagcattggctggggtgactgttcccgttccatcagtaagaaagtaaggctttagcttggacatggcttcta

SEQ ID NO: 3253 - DNA, 201 bp, Homo sapiens
tcccgttccatcagtaagaaagtaaggctttagcttggacatggcttctatgttgctcccatggcgaggaaactcatctgttttaacttcaataagacctyttctagttgacaccaaaactggtacaatctctttgtcaaaatggccagctttctgtgcattctctgtcctgttctgggacagaactgcaaccttgtcctg

SEQ ID NO: 3254 - DNA, 201 bp, Homo sapiens; identical to SEQ ID NO: 3245

SEQ ID NO: 3255 - DNA, 201 bp, Homo sapiens; identical to SEQ ID NO: 3246

SEQ ID NO: 3256 - DNA, 201 bp, Homo sapiens
cagccgggaagcgggtggggtggtgtgttacccagtagctcctgggacatcgctcgggtacgctccacgccgtcgcagccactgctgtggtcgccggtcgsccgaggggccgcgatactggttgcccgcggtgtaagcagaattcgacgtgtatcgctgccgtcaagatggaggggcctttgtccgtgttcggtgaccgca

SEQ ID NO: 3257 - DNA, 201 bp, Homo sapiens
ccttcccgccgtgccccgcggccgggccggggcagccgggaagcgggtggggtggtgtgttacccagtagctcctgggacatcgctcgggtacgctccacrccgtcgcagccactgctgtggtcgccggtcggccgaggggccgcgatactggttgcccgcggtgtaagcagaattcgacgtgtatcgctgccgtcaagat

SEQ ID NO: 3258 - DNA, 201 bp, Homo sapiens
cttcccgccgtgccccgcggccgggccggggcagccgggaagcgggtggggtggtgtgttacccagtagctcctgggacatcgctcgggtacgctccacgycgtcgcagccactgctgtggtcgccggtcggccgaggggccgcgatactggttgcccgcggtgtaagcagaattcgacgtgtatcgctgccgtcaagatg

SEQ ID NO: 3259 - DNA, 192 bp, Homo sapiens
cctgttgtccctgcctctttttccttcccgccgtgccccgcggccgggccggggcagccgggaagcgggtggggtggtgtgttacccagtakctcctgggacatcgctcgggtacgctccacgccgtcgcagccactgctgtggtcgccggtcggccgaggggccgcgatactggttgcccgcggtgtaagc

SEQ ID NO: 3260 - DNA, 201 bp, Homo sapiens; identical to SEQ ID NO: 3247

SEQ ID NO: 3261 - DNA, 201 bp, Homo sapiens; identical to SEQ ID NO: 3248

SEQ ID NO: 3262 - DNA, 201 bp, Homo sapiens; identical to SEQ ID NO: 3249

SEQ ID NO: 3263 - DNA, 201 bp, Homo sapiens; identical to SEQ ID NO: 3250

SEQ ID NO: 3264 - DNA, 201 bp, Homo sapiens
ccattctctccagtgtgtgtaacagggtcacaagaattcgacagccagatgctccaagagggtggcccaaggctatagcccctccttcaatattgacctarcgggggagaaaagatttagattgtttattcttctgtggacacagtttaaaatcttaaacttgtctttttcctcttaatgtatcagcatgctaccctttca

SEQ ID NO: 3265 - DNA, 201 bp, Homo sapiens; identical to SEQ ID NO: 3245

SEQ ID NO: 3266 - DNA, 201 bp, Homo sapiens; identical to SEQ ID NO: 3246

SEQ ID NO: 3267 - DNA, 201 bp, Homo sapiens; identical to SEQ ID NO: 3256

SEQ ID NO: 3268 - DNA, 201 bp, Homo sapiens; identical to SEQ ID NO: 3257

SEQ ID NO: 3269 - DNA, 201 bp, Homo sapiens; identical to SEQ ID NO: 3258

SEQ ID NO: 3270 - DNA, 192 bp, Homo sapiens; identical to SEQ ID NO: 3259

SEQ ID NO: 3271 - DNA, 201 bp, Homo sapiens; identical to SEQ ID NO: 3247

SEQ ID NO: 3272 - DNA, 201 bp, Homo sapiens; identical to SEQ ID NO: 3248

SEQ ID NO: 3273 - DNA, 201 bp, Homo sapiens; identical to SEQ ID NO: 3249

SEQ ID NO: 3274 - DNA, 201 bp, Homo sapiens; identical to SEQ ID NO: 3250

SEQ ID NO: 3275 - DNA, 201 bp, Homo sapiens; identical to SEQ ID NO: 3251

SEQ ID NO: 3276 - DNA, 201 bp, Homo sapiens; identical to SEQ ID NO: 3252

SEQ ID NO: 3277 - DNA, 201 bp, Homo sapiens; identical to SEQ ID NO: 3253

SEQ ID NO: 3278 - DNA, 201 bp, Homo sapiens
gttctactcatatcaaaatgaggcagtggccatagaaaatatcaagagaggcctggctagcctatttcagacacagttaagctctggaaccaccaatgagrtagatatctctggaaattgtaaagtgacctaccaggctcatcaagacaaagtgatcaaaattaaggccttggattcatgcaaaatagcgaggtctggatt

SEQ ID NO: 3279 - DNA, 201 bp, Homo sapiens
cagttcaaaagctacatctgtcaccacctataagatagaagacagctttgttatagctgtgcttgctgaagaaacacacaattttggactgaatttcctasaaaccattaaggggaaaatagtatcgaagcagaaattagagctgaagacaaccgaagcaggcccaagattgatgtctggaaagcaggctgcagccataat

SEQ ID NO: 3280 - DNA, 201 bp, Homo sapiens
agagtccacttctcagtgactcctagctgggcactggatgcagttgaggattgctggtcaatatgattcttcttgctgtgctttttctctgcttcatttcstcatattcagcttctgttaaaggtcacacaactggtctctcattaaataatgaccggctgtacaagctcacgtactccactgaagttcttcttgatcggg

SEQ ID NO: 3281 - DNA, 201 bp, Homo sapiens
tggccttactatggaggaatcctgatggtgatgatgaccagttgatccaaataacgatgaaggatgtaaatgttgaaaatgtgaatcagcagagaggagasaagagcatcttcaaaggaaaaagcccatctaaaataatgggaaaggaaaacttggaagctctgcaaagacctacgctccttcatctaatccatggaaagg

SEQ ID NO: 3282 - DNA, 201 bp, Homo sapiens
aaagagttctactcatatcaaaatgaggcagtggccatagaaaatatcaagagaggcctggctagcctatttcagacacagttaagctctggaaccaccartgaggtagatatctctggaaattgtaaagtgacctaccaggctcatcaagacaaagtgatcaaaattaaggccttggattcatgcaaaatagcgaggtct

SEQ ID NO: 3283 - DNA, 201 bp, Homo sapiens
acgtggatgtggccttactatggaggaatcctgatggtgatgatgaccagttgatccaaataacgatgaaggatgtaaatgttgaaaatgtgaatcagcasagaggagagaagagcatcttcaaaggaaaaagcccatctaaaataatgggaaaggaaaacttggaagctctgcaaagacctacgctccttcatctaatcc

SEQ ID NO: 3284 - DNA, 201 bp, Homo sapiens
ccatctaaaataatgggaaaggaaaacttggaagctctgcaaagacctacgctccttcatctaatccatggaaaggtcaaagagttctactcatatcaaartgaggcagtggccatagaaaatatcaagagaggcctggctagcctatttcagacacagttaagctctggaaccaccaatgaggtagatatctctggaaat

SEQ ID NO: 3285 - DNA, 201 bp, Homo sapiens
actaaaagccaatatagaggtccagggtggtctagctattgatatttcaggtgcaatggagtttagcttgtggtatcgtgagtctaaaacccgagtgaaawatagggtgactgtggtaataaccactgacatcacagtggactcctcttttgtgaaagctggcctggaaaccagtacagaaacagaagcaggcttggagtt

SEQ ID NO: 3286 - DNA, 201 bp, Homo sapiens
gctctccagagatatgatctccctttcataactgatgaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaa

SEQ ID NO: 3287 - DNA, 201 bp, Homo sapiens
gctgtctattggggagcttccccaagaaatgaataaatacatgctcgccattgttcaagacatcctacgttttgaaatgcctgcaagcaaaattgtccgtygagttctgaaggaaatggtcgctcacaattatgaccgtttctccaggagtggatcttcttctgcctacactggctacatagaacgtagtccccgttcggc

SEQ ID NO: 3288 - DNA, 201 bp, Homo sapiens
caaggatgaagctccattcaggcaatttgagaaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacc

SEQ ID NO: 3289 - DNA, 201 bp, Homo sapiens
ttcctcatattcagcttctgttaaaggtcacacaactggtctctcattaaataatgaccggctgtacaagctcacgtactccactgaagttcttcttgatsggggcaaaggaaaactgcaagacagcgtgggctaccgcatttcctccaacgtggatgtggccttactatggaggaatcctgatggtgatgatgaccagtt

SEQ ID NO: 3290 - DNA, 201 bp, Homo sapiens
ctctgcaaagacctacgctccttcatctaatccatggaaaggtcaaagagttctactcatatcaaaatgaggcagtggccatagaaaatatcaagagaggyctggctagcctatttcagacacagttaagctctggaaccaccaatgaggtagatatctctggaaattgtaaagtgacctaccaggctcatcaagacaaag

SEQ ID NO: 3291 - DNA, 201 bp, Homo sapiens
aggcagtggccatagaaaatatcaagagaggcctggctagcctatttcagacacagttaagctctggaaccaccaatgaggtagatatctctggaaattgyaaagtgacctaccaggctcatcaagacaaagtgatcaaaattaaggccttggattcatgcaaaatagcgaggtctggatttacgaccccaaatcaggtct

SEQ ID NO: 3292 - DNA, 201 bp, Homo sapiens
gcccaagattgatgtctggaaagcaggctgcagccataatcaaagcagttgattcaaagtacacggccattcccattgtggggcaggtcttccagagccastgtaaaggatgtccttctctctcggagctctggcggtccaccaggaaatacctgcagcctgacaacctttccaaggctgaggctgtcagaaacttcctgg

SEQ ID NO: 3293 - DNA, 201 bp, Homo sapiens
aagcagttgattcaaagtacacggccattcccattgtggggcaggtcttccagagccagtgtaaaggatgtccttctctctcggagctctggcggtccacmaggaaatacctgcagcctgacaacctttccaaggctgaggctgtcagaaacttcctggccttcattcagcacctcaggactgcgaagaaagaagagatcc

SEQ ID NO: 3294 - DNA, 201 bp, Homo sapiens
tggggcaggtcttccagagccagtgtaaaggatgtccttctctctcggagctctggcggtccaccaggaaatacctgcagcctgacaacctttccaaggcygaggctgtcagaaacttcctggccttcattcagcacctcaggactgcgaagaaagaagagatccttcaaatactaaagatggaaaataaggaagtattac

SEQ ID NO: 3295 - DNA, 201 bp, Homo sapiens
gtcaagaacatcctgctgtctattggggagcttccccaagaaatgaataaatacatgctcgccattgttcaagacatcctacgttttgaaatgcctgcaakcaaaattgtccgtcgagttctgaaggaaatggtcgctcacaattatgaccgtttctccaggagtggatcttcttctgcctacactggctacatagaacgt

SEQ ID NO: 3296 - DNA, 201 bp, Homo sapiens
gaaaataaggaagtattacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattagtaagttcaaaggt

SEQ ID NO: 3297 - DNA, 201 bp, Homo sapiens
agaaacacacaattttggactgaatttcctacaaaccattaaggggaaaatagtatcgaagcagaaattagagctgaagacaaccgaagcaggcccaagaytgatgtctggaaagcaggctgcagccataatcaaagcagttgattcaaagtacacggccattcccattgtggggcaggtcttccagagccagtgtaaagg

SEQ ID NO: 3298 - DNA, 201 bp, Homo sapiens
tctacttacagcctagacattctctactcgggttctggcattctaaggagaagtaacctgaacatctttcagtacattgggaaggctggtcttcacggtasccaggtggttattgaagcccaaggactggaagccttaatcgcagccacccctgacgagggggaggagaaccttgactcctatgctggtatgtcagccatc

SEQ ID NO: 3299 - DNA, 201 bp, Homo sapiens
ttgatgtccaaaatgctgtcagcatctggcgaccctatcagtgtggtgaaaggacttattctgctaatagatcattctcaggaacttcagttacaatctgractaaaagccaatatagaggtccagggtggtctagctattgatatttcaggtgcaatggagtttagcttgtggtatcgtgagtctaaaacccgagtgaaa

SEQ ID NO: 3300 - DNA, 201 bp, Homo sapiens
cagagaggagagaagagcatcttcaaaggaaaaagcccatctaaaataatgggaaaggaaaacttggaagctctgcaaagacctacgctccttcatctaayccatggaaaggtcaaagagttctactcatatcaaaatgaggcagtggccatagaaaatatcaagagaggcctggctagcctatttcagacacagttaagc

SEQ ID NO: 3301 - DNA, 201 bp, Homo sapiens
ttccaaggctgaggctgtcagaaacttcctggccttcattcagcacctcaggactgcgaagaaagaagagatccttcaaatactaaagatggaaaataagsaagtattacctcagctggtggatgctgtcacctctgctcagacctcagactcattagaagccattttggactttttggatttcaaaagtgacagcagcat

SEQ ID NO: 3302 - DNA, 201 bp, Homo sapiens
agcaggcttggagtttatctccacagtgcagttttctcagtacccattcttagtttgcatgcagatggacaaggatgaagctccattcaggcaatttgagwaaaagtacgaaaggctgtccacaggcagaggttatgtctctcagaaaagaaaagaaagcgtattagcaggatgtgaattcccgctccatcaagagaactc

SEQ ID NO: 3303 - DNA, 201 bp, Homo sapiens
gttcaaaggttctattggtagcagtgacatcagagaaactgttatgatcatcactgggacacttgtcagaaagttgtgtcagaatgaaggctgcaaactcwaagcagtagtggaagctaagaagttaatcctgggaggacttgaaaaagcagagaaaaaagaggacaccaggatgtatctgctggctttgaagaatgccct

SEQ ID NO: 3304 - DNA, 201 bp, Homo sapiens
gttccctaatcaggaaaaaaaaaaaaaaaaaaagtaagacacaaacaaaccattttttttctctttttttggagttgggggcccagggagaagggacaagrcttttaaaagacttgttagccaacttcaagaattaatatttatgtctctgttattgttagttttaagccttaaggtagaaggcacatagaaataacatct

SEQ ID NO: 3305 - DNA, 201 bp, Homo sapiens
gtgtctttttgagactgtaatatggtacactgtcctctaagggacatcctcattttatctcacctttttgggggtgagagctctagttcatttaactgtamtctgcacaatagctaggatgactaagagaacattgcttcaagaaactggtggatttggatttccaaaatatgaaataaggaaaaaaatgtttttatttgt

SEQ ID NO: 3306 - DNA, 201 bp, Homo sapiens
aaaatgtttttatttgtatgaattaaaagatccatgttgaacatttgcaaatatttattaataaacagatgtggtgataaacccaaaacaaatgacaggtscttattttccactaaacacagacacatgaaatgaaagtttagctagcccactatttgttgtaaattgaaaacgaagtgtgataaaataaatatgtagaaa

SEQ ID NO: 3307 - DNA, 201 bp, Homo sapiens
catattccttccccaaagaccggatgaagacagtggagcggaacttggtgcgggttgccgaggtctggctggatgagtataaggagctgttctatggccayggagaccacctcatcgaccaagggctagatgttggcaacctcacccagcaaagggagctgcgaaagaaactgaagtgcaaaagtttcaaatggtacttgg

SEQ ID NO: 3308 - DNA, 201 bp, Homo sapiens
gtcatcaaggaagacattgtgaggagggagcggataggattcagagttcagccagaccaaggaaaaattttttacagcagcataaaagagatgaaacctcycctaaggggacatgggaaaggggcatggggcaaagagaatgttagaaaaactgaggagagtgtgctcaaggttgaggtggacttggaccaaacccagagg

SEQ ID NO: 3309 - DNA, 201 bp, Homo sapiens
ggtaggaactgagctttccccttggactgctgcttcctgctgtgttcaggggagggggtcactttctggcaactctgctgctgctgctgctgctgctgctrcttcagcttcctctccactcaaggtaagcaggctaagggagggcaggctgctagggaaagctttgtaccatgaacaggatccgaaagtttttccgaggaa

SEQ ID NO: 3310 - DNA, 201 bp, Homo sapiens
aaagaagatggaaagaaggaaacttcaatgtctaccttagcgatttgatcccagtggatagagccattgaagacaccagacctgctggatgtgcagagcasctagttcacaataacctcccaaccaccagtgtcatcatgtgctttgtggatgaagtgtggtccactctcctgagatctgttcacagtgtcatcaatcgct

SEQ ID NO: 3311 - DNA, 201 bp, Homo sapiens
acggagaccacctcatcgaccaagggctagatgttggcaacctcacccagcaaagggagctgcgaaagaaactgaagtgcaaaagtttcaaatggtacttrgagaatgtctttcctgacttaagggctcccattgtgagagctagtggtgtgcttattaatgtggctttgggtaaatgcatttccattgaaaacactacag

SEQ ID NO: 3312 - DNA, 201 bp, Homo sapiens
tatttggaataccaaaagatgactcaggaaaacagtccaacattggactgaagtccttcttcggaactgggtggcctttgaattgcctgctttccaccctrtgctagacctcatcatgcaaatttccctgtgaaagctaacaggtaactggaaatgaagacagaaggacttgagaaagcatgaggatattcccaatgacta

SEQ ID NO: 3313 - DNA, 201 bp, Homo sapiens
ttggaataccaaaagatgactcaggaaaacagtccaacattggactgaagtccttcttcggaactgggtggcctttgaattgcctgctttccaccctatgytagacctcatcatgcaaatttccctgtgaaagctaacaggtaactggaaatgaagacagaaggacttgagaaagcatgaggatattcccaatgactatgt

SEQ ID NO: 3314 - DNA, 201 bp, Homo sapiens
cccaatctgaatcagtggaaaaaaatttaagtgaggaagaagaggccttcaaatgcttatttaattctaggtatgaacactatttcagttcattttgtgcytttaaaactacagttttaaagatttatgataccaataacttcctagattcatgtggattttttttaaggcaatgaaaaaaggctggattataacacactg

SEQ ID NO: 3315 - DNA, 169 bp, Homo sapiens
ctctgccagggaactggcaagcaacaaagaaggtggtgattggctggattcttgctcatggctcctggmagatctgacaaatcctcttgcttttgctctaatctctgtctggatacttttaggaaaagaaccttgttattatgtactaaagtgaataatttgtgctctt

SEQ ID NO: 3316 - DNA, 201 bp, Homo sapiens
ctctaatctctgtctggatacttttaggaaaagaaccttgttattatgtactaaagtgaataatttgtgctcttagagtaggagttggaactataggactygaaggcaagagcaggtatcttatcaaggatctactcactcagtttccctaaagctctctctccagatcggattcaaccgcacatcatgacagatgttccg

SEQ ID NO: 3317 - DNA, 201 bp, Homo sapiens
agagctgaacagcaacgacatgaaaaccaacaaagaggaacacaaattacaagactcggtccctgaaaataagggaatatccctgcgctccagacgccaarataagactgaggcagaacagcaaataactgaggtctttgtattagcagaaagaatagaaataaacagaaatgaaaagaagcccatgaagacctccccaga

SEQ ID NO: 3318 - DNA, 201 bp, Homo sapiens
ctctcagcagttgagaggctcacgcaaacatcagggcaaagcacacacacacacaaagaaccagcaagcggtgatgagggcatcaaagtattgaagcaacrtgcaaagaagaaaccaaacccagtagaagaggaacccagcaggagaaggccaagagcacctaaggaaaaggcccaacccctggaagacctggccggcttc

SEQ ID NO: 3319 - DNA, 201 bp, Homo sapiens
gcaatagacggctacaaactcgtaaggaaaaggcccaggctctagaagaactgactggcttcagagagcttttccagacaccatgcactgataaccccacractgatgagaaaactaccaaaaaaatactctgcaaatctccgcaatcagacccagcggacaccccaacaaacacaaagcaacggcccaagagaagcctca

SEQ ID NO: 3320 - DNA, 201 bp, Homo sapiens
gtcattacaaccagaaccaataaacaccccaacacacacaaaacaacagttgaaggcatccctggggaaagtaggtgtgaaagaagagctcctagcagtcrgcaagttcacacggacgtcaggggagaccacgcacacgcacagagagccagcaggagatggcaagagcatcagaacgtttaaggagtctccaaagcagat

SEQ ID NO: 3321 - DNA, 201 bp, Homo sapiens
atctgataaatgctctgcaagccctcccttaagacggcagtgtattagagaaaatggaaacgtagcaaaaacgcccaggaacacctacaaaatgacttctstggagacaaaaacttcagatactgagacagagccttcaaaaacagtatccactgcaaacaggtcaggaaggtctacagagttcaggaatatacagaagct

SEQ ID NO: 3322 - DNA, 201 bp, Homo sapiens
ctggcagcaagagacggccacaaactcctaaagaaaaggccaaggctctagaagatctggctggcttcaaagagctcttccagacaccaggtcacactgasgaatcaatgaccgatgacaaaatcacagaagtatcctgcaaatctccacaaccagacccagtcaaaaccccaacaagctccaagcaacgactcaagatat

SEQ ID NO: 3323 - DNA, 201 bp, Homo sapiens
gtcctgcaaaacagcccctgcttccagcagcaaatctcagacagaggttcctaagagaggagggagaaagagtggcaacctgccttcaaagagagtgtctmtcagccgaagtcaacatgatattttacagatgatatgttccaaaagaagaagtggtgcttcggaagcaaatctgattgttgcaaaatcatgggcagatgt

SEQ ID NO: 3324 - DNA, 201 bp, Homo sapiens
tgcactgataaccccacgactgatgagaaaactaccaaaaaaatactctgcaaatctccgcaatcagacccagcggacaccccaacaaacacaaagcaacrgcccaagagaagcctcaagaaagcagacgtagaggaagaatttttagcattcaggaaactaacaccatcagcaggcaaagccatgcacacgcctaaagca

SEQ ID NO: 3325 - DNA, 201 bp, Homo sapiens; identical to SEQ ID NO: 3320

SEQ ID NO: 3326 - DNA, 201 bp, Homo sapiens
gacatgaaaaccaacaaagaggaacacaaattacaagactcggtccctgaaaataagggaatatccctgcgctccagacgccaaaataagactgaggcagracagcaaataactgaggtctttgtattagcagaaagaatagaaataaacagaaatgaaaagaagcccatgaagacctccccagagatggacattcagaat

SEQ ID NO: 3327 - DNA, 201 bp, Homo sapiens
gctggacgcagaagatgtaattggcagcaggagacagccaagagcacctaaggaaaaggcccaacccctggaagatctggccagcttccaagagctctctmaaacaccaggccacactgaggaactggcaaatggtgctgctgatagctttacaagcgctccaaagcaaacacctgacagtggaaaacctctaaaaatatc

SEQ ID NO: 3328 - DNA, 201 bp, Homo sapiens
ctggcttcaaagacccagcagcaggtcacactgaagaatcaatgactgatgacaaaaccactaaaataccctgcaaatcatcaccagaactagaagacacygcaacaagctcaaagagacggcccaggacacgtgcccagaaagtagaagtgaaggaggagctgttagcagttggcaagctcacacaaacctcaggggaga

SEQ ID NO: 3329 - DNA, 201 bp, Homo sapiens
tgaaagaagagcccctagcagtcagcaagctcacacggacatcaggggagactacgcaaacacacacagagccaacaggagatagtaagagcatcaaagcrtttaaggagtctccaaagcagatcctggacccagcagcaagtgtaactggtagcaggaggcagctgagaactcgtaaggaaaaggcccgtgctctagaag

SEQ ID NO: 3330 - DNA, 201 bp, Homo sapiens
actgataaccccacgactgatgagaaaactaccaaaaaaatactctgcaaatctccgcaatcagacccagcggacaccccaacaaacacaaagcaacggcycaagagaagcctcaagaaagcagacgtagaggaagaatttttagcattcaggaaactaacaccatcagcaggcaaagccatgcacacgcctaaagcagca

SEQ ID NO: 3331 - DNA, 201 bp, Homo sapiens
acgtagaagaagaattcttcgcactcaggaaacgaacaccatcagcaggcaaagccatgcacacacccaaaccagcagtaagtggtgagaaaaacatctaygcatttatgggaactccagtgcagaaactggacctgacagagaacttaactggcagcaagagacggctacaaactcctaaggaaaaggcccaggctctag

SEQ ID NO: 3332 - DNA, 201 bp, Homo sapiens
gcagatcacaaccagacccagtggacacaccaacaagctccaagccacagtccaagagaagtctcaggaaagtggacgtagaagaagaattcttcgcactyaggaaacgaacaccatcagcaggcaaagccatgcacacacccaaaccagcagtaagtggtgagaaaaacatctacgcatttatgggaactccagtgcaga

SEQ ID NO: 3333 - DNA, 201 bp, Homo sapiens
acgactcacgagaaaactaccaaaatagcctgcagatcacaaccagacccagtggacacaccaacaagctccaagccacagtccaagagaagtctcaggamagtggacgtagaagaagaattcttcgcactcaggaaacgaacaccatcagcaggcaaagccatgcacacacccaaaccagcagtaagtggtgagaaaaac

SEQ ID NO: 3334 - DNA, 201 bp, Homo sapiens
aagtggccaagaacgcctaaggaagaggcccagtcactagaagacctggctggcttcaaagagctcttccagacaccaggtccctctgaggaatcaatgastgatgagaaaactaccaaaatagcctgcaaatctccaccaccagaatcagtggacactccaacaagcacaaagcaatggcctaagagaagtctcaggaaa

SEQ ID NO: 3335 - DNA, 201 bp, Homo sapiens
actttggagagcgaatctgtgcagagagtaacgcggagtgtcaagagatgtgcagaaaatccaaagaaggctgaggacaatgtgtgtgtcaagaaaataasaaccagaagtcatagggacagtgaagatatttgacagaaaaatcgaactgggaaaaatataataaagttagttttgtgataagttctagtgcagtttttg

SEQ ID NO: 3336 - DNA, 201 bp, Homo sapiens
tcaagaaagacaaaaagccagcctgcagcaagcactttggagagcgaatctgtgcagagagtaacgcggagtgtcaagagatgtgcagaaaatccaaagarggctgaggacaatgtgtgtgtcaagaaaataagaaccagaagtcatagggacagtgaagatatttgacagaaaaatcgaactgggaaaaatataataaag

SEQ ID NO: 3337 - DNA, 201 bp, Homo sapiens
cgtgtgcagaaggtacaagtaaaagaagagccttcagcagtcaagttcacacaaacatcaggggaaaccacggatgcagacaaagaaccagcaggtgaagrtaaaggcatcaaagcattgaaggaatctgcaaaacagacaccggctccagcagcaagtgtaactggcagcaggagacggccaagagcacccagggaaagt

SEQ ID NO: 3338 - DNA, 201 bp, Homo sapiens
tgaaacatcaggtcacactcaggaatcactgactgctggcaaagccactaaaataccctgcgaatctcccccactagaagtggtagacaccacagcaagcmcaaagaggcatctcaggacacgtgtgcagaaggtacaagtaaaagaagagccttcagcagtcaagttcacacaaacatcaggggaaaccacggatgcaga

SEQ ID NO: 3339 - DNA, 201 bp, Homo sapiens
gagtcaatgactattgacaaaaacacaaaaattccctgcaaatctcccccaccagaactaacagacactgccacgagcacaaagagatgccccaagacacrtcccaggaaagaagtaaaagaggagctctcagcagttgagaggctcacgcaaacatcagggcaaagcacacacacacacaaagaaccagcaagcggtgat

SEQ ID NO: 3340 - DNA, 201 bp, Homo sapiens
cctaaggaaaaggcccaggctctagaagacctggctggctttaaagagctcttccagactcctggtcacaccgaggaattagtggctgctggtaaaaccaytaaaataccctgcgactctccacagtcagacccagtggacaccccaacaagcacaaagcaacgacccaagagaagtatcaggaaagcagatgtagaggga

SEQ ID NO: 3341 - DNA, 201 bp, Homo sapiens
caacacatttgtggggactccagtggagaaactggacctgctaggaaatttacctggcagcaagagacggccacaaactcctaaagaaaaggccaaggctmtagaagatctggctggcttcaaagagctcttccagacaccaggtcacactgaggaatcaatgaccgatgacaaaatcacagaagtatcctgcaaatctcc

SEQ ID NO: 3342 - DNA, 201 bp, Homo sapiens
actccagtgcagaaactggacctggcaggaactttacctggcagcaaaagacagctacagactcctaaggaaaaggcccaggctctagaagacctggctgkctttaaagagctcttccagactcctggtcacaccgaggaattagtggctgctggtaaaaccactaaaataccctgcgactctccacagtcagacccagtg

SEQ ID NO: 3343 - DNA, 201 bp, Homo sapiens
aagcaatgaagagatcaagaacttgggggcagaaatgtgcaccaatgtctgacctgacagacctcaagagcttgcctgatacagaactcatgaaagacacrgcacgtggccagaatctcctccaaacccaagatcatgccaaggcaccaaagagtgagaaaggcaaaatcactaaaatgccctgccagtcattacaaccag

SEQ ID NO: 3344 - DNA, 201 bp, Homo sapiens; identical to SEQ ID NO: 3323

SEQ ID NO: 3345 - DNA, 201 bp, Homo sapiens
ataaacagaaatgaaaagaagcccatgaagacctccccagagatggacattcagaatccagatgatggagcccggaaacccatacctagagacaaagtcastgagaacaaaaggtgcttgaggtctgctagacagaatgagagctcccagcctaaggtggcagaggagagcggagggcagaagagtgcgaaggttctcatg

SEQ ID NO: 3346 - DNA, 201 bp, Homo sapiens
agagaagtttgaggacttctgcaaaaagaattgaacctgcggaagagctgaacagcaacgacatgaaaaccaacaaagaggaacacaaattacaagactcrgtccctgaaaataagggaatatccctgcgctccagacgccaaaataagactgaggcagaacagcaaataactgaggtctttgtattagcagaaagaatag

SEQ ID NO: 3347 - DNA, 201 bp, Homo sapiens
aaggcatcaaagcattgaaggaatctgcaaaacagacaccggctccagcagcaagtgtaactggcagcaggagacggccaagagcacccagggaaagtgcycaagccatagaagacctagctggcttcaaagacccagcagcaggtcacactgaagaatcaatgactgatgacaaaaccactaaaataccctgcaaatcat

SEQ ID NO: 3348 - DNA, 201 bp, Homo sapiens
tcaatgactattgacaaaaacacaaaaattccctgcaaatctcccccaccagaactaacagacactgccacgagcacaaagagatgccccaagacacgtcycaggaaagaagtaaaagaggagctctcagcagttgagaggctcacgcaaacatcagggcaaagcacacacacacacaaagaaccagcaagcggtgatgag

SEQ ID NO: 3349 - DNA, 201 bp, Homo sapiens
agctgagaactcctaagggaaagtctgaagtccctgaagacctggccggcttcatcgagctcttccagacaccaagtcacactaaggaatcaatgactaaygaaaaaactaccaaagtatcctacagagcttcacagccagacctagtggacaccccaacaagctccaagccacagcccaagagaagtctcaggaaagcag

SEQ ID NO: 3350 - DNA, 201 bp, Homo sapiens
aaaatgccctgcgaatcttctccaccagaatcagcagacaccccaacaagcacaagaaggcagcccaagacacctttggagaaaagggacgtacagaaggwgctctcagccctgaagaagctcacacagacatcaggggaaaccacacacacagataaagtaccaggaggtgaggataaaagcatcaacgcgtttagggaa

SEQ ID NO: 3351 - DNA, 201 bp, Homo sapiens
gcaacaagctcaaagagacggcccaggacacgtgcccagaaagtagaagtgaaggaggagctgttagcagttggcaagctcacacaaacctcaggggagascacgcacaccgacaaagagccggtaggtgagggcaaaggcacgaaagcatttaagcaacctgcaaagcggaagctggacgcagaagatgtaattggcagc

SEQ ID NO: 3352 - DNA, 201 bp, Homo sapiens
accgacaaagagccggtaggtgagggcaaaggcacgaaagcatttaagcaacctgcaaagcggaagctggacgcagaagatgtaattggcagcaggagacrgccaagagcacctaaggaaaaggcccaacccctggaagatctggccagcttccaagagctctctcaaacaccaggccacactgaggaactggcaaatggt

SEQ ID NO: 3353 - DNA, 201 bp, Homo sapiens
atcaaagcattgaaggaatctgcaaaacagacaccggctccagcagcaagtgtaactggcagcaggagacggccaagagcacccagggaaagtgcccaagycatagaagacctagctggcttcaaagacccagcagcaggtcacactgaagaatcaatgactgatgacaaaaccactaaaataccctgcaaatcatcacca

SEQ ID NO: 3354 - DNA, 201 bp, Homo sapiens
ccacgactcacgagaaaactaccaaaatagcctgcagatcacaaccagacccagtggacacaccaacaagctccaagccacagtccaagagaagtctcagsaaagtggacgtagaagaagaattcttcgcactcaggaaacgaacaccatcagcaggcaaagccatgcacacacccaaaccagcagtaagtggtgagaaaa

SEQ ID NO: 3355 - DNA, 201 bp, Homo sapiens
aagaaggcagcccaagacacctttggagaaaagggacgtacagaaggagctctcagccctgaagaagctcacacagacatcaggggaaaccacacacacasataaagtaccaggaggtgaggataaaagcatcaacgcgtttagggaaactgcaaaacagaaactggacccagcagcaagtgtaactggtagcaagaggca

SEQ ID NO: 3356 - DNA, 201 bp, Homo sapiens
tcacaaccagacccagtggacacaccaacaagctccaagccacagtccaagagaagtctcaggaaagtggacgtagaagaagaattcttcgcactcaggawacgaacaccatcagcaggcaaagccatgcacacacccaaaccagcagtaagtggtgagaaaaacatctacgcatttatgggaactccagtgcagaaactg

SEQ ID NO: 3357 - DNA, 201 bp, Homo sapiens
caatagacggctacaaactcgtaaggaaaaggcccaggctctagaagaactgactggcttcagagagcttttccagacaccatgcactgataaccccacgrctgatgagaaaactaccaaaaaaatactctgcaaatctccgcaatcagacccagcggacaccccaacaaacacaaagcaacggcccaagagaagcctcaa

SEQ ID NO: 3358 - DNA, 201 bp, Homo sapiens
gcagaatcagaaagggaaaggagaagcaggaaattcagactccatgtgcctgagatcaagaaagacaaaaagccagcctgcagcaagcactttggagagcraatctgtgcagagagtaacgcggagtgtcaagagatgtgcagaaaatccaaagaaggctgaggacaatgtgtgtgtcaagaaaataagaaccagaagtca

SEQ ID NO: 3359 - DNA, 201 bp, Homo sapiens
cagactccatgtgcctgagatcaagaaagacaaaaagccagcctgcagcaagcactttggagagcgaatctgtgcagagagtaacgcggagtgtcaagagrtgtgcagaaaatccaaagaaggctgaggacaatgtgtgtgtcaagaaaataagaaccagaagtcatagggacagtgaagatatttgacagaaaaatcgaa

SEQ ID NO: 3360 - DNA, 201 bp, Homo sapiens
tcaacgcgtttagggaaactgcaaaacagaaactggacccagcagcaagtgtaactggtagcaagaggcacccaaaaactaaggaaaaggcccaacccctrgaagacctggctggcttgaaagagctcttccagacaccagtatgcactgacaagcccacgactcacgagaaaactaccaaaatagcctgcagatcacaac

SEQ ID NO: 3361 - DNA, 201 bp, Homo sapiens; identical to SEQ ID NO: 3340

SEQ ID NO: 3362 - DNA, 201 bp, Homo sapiens
cagcaggaggtgatgagaaagacattaaagcatttatgggaactccagtgcagaaactggacctggcaggaactttacctggcagcaaaagacagctacaractcctaaggaaaaggcccaggctctagaagacctggctggctttaaagagctcttccagactcctggtcacaccgaggaattagtggctgctggtaaaa

SEQ ID NO: 3363 - DNA, 201 bp, Homo sapiens
ctgagaaattgggcactacagctggacagatgtgctctgggttacctggtcttagttcagttgatatcaacaactttggtgattccattaatgagagtgasggaatacctttgaaaagaaggcgtgtgtcctttggtgggcacctaagacctgaactatttgatgaaaacttgcctcctaatacgcctctcaaaaggggag

SEQ ID NO: 3364 - DNA, 201 bp, Homo sapiens; identical to SEQ ID NO: 3318

SEQ ID NO: 3365 - DNA, 201 bp, Homo sapiens
gaagaatcaatgactgatgacaaaaccactaaaataccctgcaaatcatcaccagaactagaagacaccgcaacaagctcaaagagacggcccaggacacrtgcccagaaagtagaagtgaaggaggagctgttagcagttggcaagctcacacaaacctcaggggagaccacgcacaccgacaaagagccggtaggtgag

SEQ ID NO: 3366 - DNA, 201 bp, Homo sapiens
gcatcaaagcgtttaaggaatctgcaaagcagatgctggacccagcaaactatggaactgggatggagaggtggccaagaacacctaaggaagaggcccartcactagaagacctggccggcttcaaagagctcttccagacaccagaccacactgaggaatcaacaactgatgacaaaactaccaaaatagcctgcaaat

SEQ ID NO: 3367 - DNA, 201 bp, Homo sapiens
agaaactggacctgctaggaaatttacctggcagcaagagacggccacaaactcctaaagaaaaggccaaggctctagaagatctggctggcttcaaagarctcttccagacaccaggtcacactgaggaatcaatgaccgatgacaaaatcacagaagtatcctgcaaatctccacaaccagacccagtcaaaaccccaa

SEQ ID NO: 3368 - DNA, 201 bp, Homo sapiens
attcctcagaacatgctggacgtaatggcagaaatgcagctgatcccatttctggggattttaaagaaatttccagcgttaaattagtgagccgttatggwgaattgaagtctgttcccactacacaatgtcttgacaatagcaaaaaaaatgaatctcccttttggaagctttatgagtcagtgaagaaagagttggatg

SEQ ID NO: 3369 - DNA, 201 bp, Homo sapiens
caaactcctaaggaaaaggcccaggctctagaagacctggctggcttcaaagagctcttccagacaccaggcactgacaagcccacgactgatgagaaaamtaccaaaatagcctgcaaatctccacaaccagacccagtggacaccccagcaagcacaaagcaacggcccaagagaagcctcaggaaagcagacgtagag

SEQ ID NO: 3370 - DNA, 201 bp, Homo sapiens
atgcacactccacctgtcctgaagaaaatcatcaaggaacagcctcaaccatcaggaaaacaagagtcaggttcagaaatccatgtggaagtgaaggcacmaagcttggttataagccctccagctcctagtcctaggaaaactccagttgccagtgatcaacgccgtaggtcctgcaaaacagcccctgcttccagcagc

SEQ ID NO: 3371 - DNA, 201 bp, Homo sapiens
agagccgggcgcccggggacgtagcctgtagggccaccgggtccccgtcagaggcggcggcgggagcagcggggactgcaggccggggtgcagcgaacgckaccccgcgggctgcggcccggtgtgtgcggagcgtggcgggcgcagcttaccgggcggaggtgagcgcggcgccggctcctcctgcggcggactttgggt

SEQ ID NO: 3372 - DNA, 201 bp, Homo sapiens
agcggggactgcaggccggggtgcagcgaacgcgaccccgcgggctgcggcccggtgtgtgcggagcgtggcgggcgcagcttaccgggcggaggtgagckcggcgccggctcctcctgcggcggactttgggtgcgacttgacgagcggtggttcgacaagtggccttgcgggccggatcgtcccagtggaagagttgta

SEQ ID NO: 3373 - DNA, 201 bp, Homo sapiens; identical to SEQ ID NO: 3352

SEQ ID NO: 3374 - DNA, 201 bp, Homo sapiens
caagctcacacaaacctcaggggagaccacgcacaccgacaaagagccggtaggtgagggcaaaggcacgaaagcatttaagcaacctgcaaagcggaagstggacgcagaagatgtaattggcagcaggagacagccaagagcacctaaggaaaaggcccaacccctggaagatctggccagcttccaagagctctctca

SEQ ID NO: 3375 - DNA, 201 bp, Homo sapiens; identical to SEQ ID NO: 3365

SEQ ID NO: 3376 - DNA, 201 bp, Homo sapiens
gaagaactgactggcttcagagagcttttccagacaccatgcactgataaccccacgactgatgagaaaactaccaaaaaaatactctgcaaatctccgcwatcagacccagcggacaccccaacaaacacaaagcaacggcccaagagaagcctcaagaaagcagacgtagaggaagaatttttagcattcaggaaacta

SEQ ID NO: 3377 - DNA, 201 bp, Homo sapiens
agaaatttccagcgttaaattagtgagccgttatggagaattgaagtctgttcccactacacaatgtcttgacaatagcaaaaaaaatgaatctccctttwggaagctttatgagtcagtgaagaaagagttggatgtaaaatcacaaaaagaaaatgtcctacagtattgtagaaaatctggattacaaactgattacgc

SEQ ID NO: 3378 - DNA, 201 bp, Homo sapiens
cgcactcaggaaacgaacaccatcagcaggcaaagccatgcacacacccaaaccagcagtaagtggtgagaaaaacatctacgcatttatgggaactccartgcagaaactggacctgacagagaacttaactggcagcaagagacggctacaaactcctaaggaaaaggcccaggctctagaagacctggctggctttaa

SEQ ID NO: 3379 - DNA, 201 bp, Homo sapiens
aaggcatccctggggaaagtaggtgtgaaagaagagctcctagcagtcggcaagttcacacggacgtcaggggagaccacgcacacgcacagagagccagyaggagatggcaagagcatcagaacgtttaaggagtctccaaagcagatcctggacccagcagcccgtgtaactggaatgaagaagtggccaagaacgcct

SEQ ID NO: 3380 - DNA, 201 bp, Homo sapiens
gctccccacctcagagagttttggaggaaatgtgttcttcagtgcacagaatgcagcaaaacagccatctgataaatgctctgcaagccctcccttaagayggcagtgtattagagaaaatggaaacgtagcaaaaacgcccaggaacacctacaaaatgacttctctggagacaaaaacttcagatactgagacagagcc

SEQ ID NO: 3381 - DNA, 201 bp, Homo sapiens
agccaagaactcctaagggaaaagcccaacccctagaagacttggctggcttgaaagagctcttccagacaccaatatgcactgacaagcccacgactcaygagaaaactaccaaaatagcctgcagatctccacaaccagacccagtgggtaccccaacaatcttcaagccacagtccaagagaagtctcaggaaagcag

SEQ ID NO: 3382 - DNA, 201 bp, Homo sapiens
gcagcccaagacacctttggagaaaagggacgtacagaaggagctctcagccctgaagaagctcacacagacatcaggggaaaccacacacacagataaartaccaggaggtgaggataaaagcatcaacgcgtttagggaaactgcaaaacagaaactggacccagcagcaagtgtaactggtagcaagaggcacccaaa

SEQ ID NO: 3383 - DNA, 201 bp, Homo sapiens
actgcaaaacagaaactggacccagcagcaagtgtaactggtagcaagaggcacccaaaaactaaggaaaaggcccaacccctagaagacctggctggctkgaaagagctcttccagacaccagtatgcactgacaagcccacgactcacgagaaaactaccaaaatagcctgcagatcacaaccagacccagtggacaca

SEQ ID NO: 3384 - DNA, 201 bp, Homo sapiens
tgaaagaagagctcctagcagtcggcaagttcacacggacgtcaggggagaccacgcacacgcacagagagccagcaggagatggcaagagcatcagaacrtttaaggagtctccaaagcagatcctggacccagcagcccgtgtaactggaatgaagaagtggccaagaacgcctaaggaagaggcccagtcactagaag

SEQ ID NO: 3385 - DNA, 201 bp, Homo sapiens
gcaagctcacacaaacctcaggggagaccacgcacaccgacaaagagccggtaggtgagggcaaaggcacgaaagcatttaagcaacctgcaaagcggaasctggacgcagaagatgtaattggcagcaggagacagccaagagcacctaaggaaaaggcccaacccctggaagatctggccagcttccaagagctctctc

SEQ ID NO: 3386 - DNA, 201 bp, Homo sapiens
gataaaggcatcaaagcattgaaggaatctgcaaaacagacaccggctccagcagcaagtgtaactggcagcaggagacggccaagagcacccagggaaartgcccaagccatagaagacctagctggcttcaaagacccagcagcaggtcacactgaagaatcaatgactgatgacaaaaccactaaaataccctgcaaa

SEQ ID NO: 3387 - DNA, 201 bp, Homo sapiens
gacaaagaaccagcaggtgaagataaaggcatcaaagcattgaaggaatctgcaaaacagacaccggctccagcagcaagtgtaactggcagcaggagacrgccaagagcacccagggaaagtgcccaagccatagaagacctagctggcttcaaagacccagcagcaggtcacactgaagaatcaatgactgatgacaaa

SEQ ID NO: 3388 - DNA, 201 bp, Homo sapiens
gaagaggcccaatcactagaagacctggccggcttcaaagagctcttccagacaccagaccacactgaggaatcaacaactgatgacaaaactaccaaaayagcctgcaaatctccaccaccagaatcaatggacactccaacaagcacaaggaggcggcccaaaacacctttggggaaaagggatatagtggaagagctc

SEQ ID NO: 3389 - DNA, 201 bp, Homo sapiens
gctggctttaaagagctcttccagacacgaggtcacactgaggaatcaatgactaacgataaaactgccaaagtagcctgcaaatcttcacaaccagaccyagacaaaaacccagcaagctccaagcgacggctcaagacatccctggggaaagtgggcgtgaaagaagagctcctagcagttggcaagctcacacagaca

SEQ ID NO: 3390 - DNA, 201 bp, Homo sapiens; identical to SEQ ID NO: 3378

SEQ ID NO: 3391 - DNA, 201 bp, Homo sapiens
gtaaatgggtctgttattgatgagcctgtacggctaaaacatggagatgtaataactattattgatcgttccttcaggtatgaaaatgaaagtcttcagartggaaggaagtcaactgaatttccaagaaaaatacgtgaacaggagccagcacgtcgtgtctcaagatctagcttctcttctgaccctgatgagaaagct

SEQ ID NO: 3392 - DNA, 201 bp, Homo sapiens
atgagggcatcaaagtattgaagcaacgtgcaaagaagaaaccaaacccagtagaagaggaacccagcaggagaaggccaagagcacctaaggaaaaggcycaacccctggaagacctggccggcttcacagagctctctgaaacatcaggtcacactcaggaatcactgactgctggcaaagccactaaaataccctgcg

SEQ ID NO: 3393 - DNA, 201 bp, Homo sapiens
gagagacagcaggagatggaaagagcatcaaagcgtttaaggaatctgcaaagcagatgctggacccagcaaactatggaactgggatggagaggtggccragaacacctaaggaagaggcccaatcactagaagacctggccggcttcaaagagctcttccagacaccagaccacactgaggaatcaacaactgatgaca

SEQ ID NO: 3394 - DNA, 201 bp, Homo sapiens
aaggcccaacccctagaagacctggctggcttgaaagagctcttccagacaccagtatgcactgacaagcccacgactcacgagaaaactaccaaaatagmctgcagatcacaaccagacccagtggacacaccaacaagctccaagccacagtccaagagaagtctcaggaaagtggacgtagaagaagaattcttcgca

SEQ ID NO: 3395 - DNA, 201 bp, Homo sapiens
gacccaagagaagtatcaggaaagcagatgtagagggagaactcttagcgtgcaggaatctaatgccatcagcaggcaaagccatgcacacgcctaaaccrtcagtaggtgaagagaaagacatcatcatatttgtgggaactccagtgcagaaactggacctgacagagaacttaaccggcagcaagagacggccacaaa

SEQ ID NO: 3396 - DNA, 201 bp, Homo sapiens; identical to SEQ ID NO: 3369

SEQ ID NO: 3397 - DNA, 201 bp, Homo sapiens
ggaacacaaattacaagactcggtccctgaaaataagggaatatccctgcgctccagacgccaaaataagactgaggcagaacagcaaataactgaggtcwttgtattagcagaaagaatagaaataaacagaaatgaaaagaagcccatgaagacctccccagagatggacattcagaatccagatgatggagcccggaa

SEQ ID NO: 3398 - DNA, 201 bp, Homo sapiens
catttaagcaacctgcaaagcggaagctggacgcagaagatgtaattggcagcaggagacagccaagagcacctaaggaaaaggcccaacccctggaagayctggccagcttccaagagctctctcaaacaccaggccacactgaggaactggcaaatggtgctgctgatagctttacaagcgctccaaagcaaacacctg

SEQ ID NO: 3399 - DNA, 201 bp, Homo sapiens
accagcaagcggtgatgagggcatcaaagtattgaagcaacgtgcaaagaagaaaccaaacccagtagaagaggaacccagcaggagaaggccaagagcayctaaggaaaaggcccaacccctggaagacctggccggcttcacagagctctctgaaacatcaggtcacactcaggaatcactgactgctggcaaagccac

SEQ ID NO: 3400 - DNA, 201 bp, Homo sapiens
ggaaacgtagcaaaaacgcccaggaacacctacaaaatgacttctctggagacaaaaacttcagatactgagacagagccttcaaaaacagtatccactgyaaacaggtcaggaaggtctacagagttcaggaatatacagaagctacctgtggaaagtaagagtgaagaaacaaatacagaaattgttgagtgcatccta

SEQ ID NO: 3401 - DNA, 201 bp, Homo sapiens
gcctaaggtggcagaggagagcggagggcagaagagtgcgaaggttctcatgcagaatcagaaagggaaaggagaagcaggaaattcagactccatgtgcytgagatcaagaaagacaaaaagccagcctgcagcaagcactttggagagcgaatctgtgcagagagtaacgcggagtgtcaagagatgtgcagaaaatcc

SEQ ID NO: 3402 - DNA, 201 bp, Homo sapiens
gaaacaaacgccatcagcaggcaaagccatgcacacacccaaaccagcagtaggtgaagagaaagacatcaacacgtttttgggaactccagtgcagaaastggaccagccaggaaatttacctggcagcaatagacggctacaaactcgtaaggaaaaggcccaggctctagaagaactgactggcttcagagagctttt

SEQ ID NO: 3403 - DNA, 201 bp, Homo sapiens
gacaccaggtccctctgaggaatcaatgactgatgagaaaactaccaaaatagcctgcaaatctccaccaccagaatcagtggacactccaacaagcacaragcaatggcctaagagaagtctcaggaaagcagatgtagaggaagaattcttagcactcaggaaactaacaccatcagcagggaaagccatgcttacgcc

SEQ ID NO: 3404 - DNA, 201 bp, Homo sapiens
gagccgggcgcccggggacgtagcctgtagggccaccgggtccccgtcagaggcggcggcgggagcagcggggactgcaggccggggtgcagcgaacgcgrccccgcgggctgcggcccggtgtgtgcggagcgtggcgggcgcagcttaccgggcggaggtgagcgcggcgccggctcctcctgcggcggactttgggtg

SEQ ID NO: 3405 - DNA, 201 bp, Homo sapiens
aggctctagaagacctggctggctttaaagagctcttccagactcctggtcacaccgaggaattagtggctgctggtaaaaccactaaaataccctgcgahtctccacagtcagacccagtggacaccccaacaagcacaaagcaacgacccaagagaagtatcaggaaagcagatgtagagggagaactcttagcgtgca

SEQ ID NO: 3406 - DNA, 201 bp, Homo sapiens
aacaacattgcaaaattgaaatccatgagcaggaggcaatattacataatttcagttccacaaatccaacacaagtaaatgggtctgttattgatgagccwgtacggctaaaacatggagatgtaataactattattgatcgttccttcaggtatgaaaatgaaagtcttcagagtggaaggaagtcaactgaatttccaa

SEQ ID NO: 3407 - DNA, 201 bp, Homo sapiens
ttgtgataagttctagtgcagtttttgtcataaattacaagtgaattctgtaagtaaggctgtcagtctgcttaagggaagaaaactttggatttgctggstctgaatcggcttcataaactccactgggagcactgctgggctcctggactgagaatagttgaacaccgggggctttgtgaaggagtctgggccaaggtt

SEQ ID NO: 3408 - DNA, 201 bp, Homo sapiens
ggtttgccctcagctttgcagaatgaagccttgaggtctgtcaccacccacagccaccctacagcagccttaactgtgacacttgccacactgtgtcgtcrtttgtttgcctatgtcctccagggcacggtggcaggaacaactatcctcgtctgtcccaacactgagcaggcactcggtaaacacgaatgaatggatgag

SEQ ID NO: 3409 - DNA, 201 bp, Homo sapiens
tgcagaatgaagccttgaggtctgtcaccacccacagccaccctacagcagccttaactgtgacacttgccacactgtgtcgtcgtttgtttgcctatgtyctccagggcacggtggcaggaacaactatcctcgtctgtcccaacactgagcaggcactcggtaaacacgaatgaatggatgagcgcacggatgaatgga

SEQ ID NO: 3410 - DNA, 201 bp, Homo sapiens
tcgtttgtttgcctatgtcctccagggcacggtggcaggaacaactatcctcgtctgtcccaacactgagcaggcactcggtaaacacgaatgaatggatragcgcacggatgaatggagcttacaagatctgtctttccaatggccgggggcatttggtccccaaattaaggctattggacatctgcacaggacagtcct

SEQ ID NO: 3411 - DNA, 201 bp, Homo sapiens
tggtccccaaattaaggctattggacatctgcacaggacagtcctatttttgatgtcctttcctttctgaaaataaagttttgtgctttggagaatgactygtgagcacatctttagggaccaagagtgactttctgtaaggagtgactcgtggcttgccttggtctcttgggaatacttttctaactagggttgctctca

SEQ ID NO: 3412 - DNA, 201 bp, Homo sapiens
cagcccgatgccacccagtacaggaagtgacaccagtactctgtaaagcatcatcatccttggagagactgagcactcagcaccttcagccacgatttcargatcgcttccttgtgagccgctgcctccgaaatctcctttgaagcccagacatctttctccagcttcagacttgtagatataactcgttcatcttcattt

SEQ ID NO: 3413 - DNA, 201 bp, Homo sapiens
cagacttgtagatataactcgttcatcttcatttactttccactttgccccctgtcctctctgtgttccccaaatcagagaatagcccgccatcccccagrtcacctgtctggattcctccccattcacccaccttgccaggtgcaggtgaggatggtgcaccagacagggtagctgtcccccaaaatgtgccctgtgcgg

SEQ ID NO: 3414 - DNA, 201 bp, Homo sapiens
tggattcctccccattcacccaccttgccaggtgcaggtgaggatggtgcaccagacagggtagctgtcccccaaaatgtgccctgtgcgggcagtgcccygtctccacgtttgtttccccagtgtctggcggggagccaggtgacatcataaatacttgctgaatgaatgcagaaatcagcggtactgacttgtactata

SEQ ID NO: 3415 - DNA, 201 bp, Homo sapiens
gaacaccacttctacacaaccctccttggtactgggggagggagagatctgacaaatactgcccattcccctaggctgactggatttgagaacaaataccmacccatttccaccatggtatggtaacttctctgagcttcagtttccaagtgaatttccatgtaataggacattcccattaaatacaagctgtttttactt

SEQ ID NO: 3416 - DNA, 201 bp, Homo sapiens
ctgggggagggagagatctgacaaatactgcccattcccctaggctgactggatttgagaacaaatacccacccatttccaccatggtatggtaacttctstgagcttcagtttccaagtgaatttccatgtaataggacattcccattaaatacaagctgtttttactttttcgcctcccagggcctgtgggatctggtc

SEQ ID NO: 3417 - DNA, 201 bp, Homo sapiens
gtaacttctctgagcttcagtttccaagtgaatttccatgtaataggacattcccattaaatacaagctgtttttactttttcgcctcccagggcctgtgsgatctggtcccccagcctctcttgggctttcttacactaactctgtacctaccatctcctgcctcccttaggcaggcacctccaaccaccacacactccc

SEQ ID NO: 3418 - DNA, 201 bp, Homo sapiens
ttcttacactaactctgtacctaccatctcctgcctcccttaggcaggcacctccaaccaccacacactccctgctgttttccctgcctggaactttcccwcctgccccaccaagatcatttcatccagtcctgagctcagcttaagggaggcttcttgcctgtgggttccctcacccccatgcctgtcctccaggctggg

SEQ ID NO: 3419 - DNA, 201 bp, Homo sapiens
ttacactaactctgtacctaccatctcctgcctcccttaggcaggcacctccaaccaccacacactccctgctgttttccctgcctggaactttccctccwgccccaccaagatcatttcatccagtcctgagctcagcttaagggaggcttcttgcctgtgggttccctcacccccatgcctgtcctccaggctggggca

SEQ ID NO: 3420 - DNA, 176 bp, Homo sapiens
cctctttgtagcacgtagtgttgtggaaactaagccactaattgagtttctggctcccctcctggggttgtaagttttgttcattcatgagggccgactgyatttcctggttactgtatcccagtgaccagccacaggagatgtccaataaagtatgtgatgaaatggtcttaaaa

SEQ ID NO: 3421 - DNA, 161 bp, Homo sapiens
tagtgttgtggaaactaagccactaattgagtttctggctcccctcctggggttgtaagttttgttcattcatgagggccgactgtatttcctggttactstatcccagtgaccagccacaggagatgtccaataaagtatgtgatgaaatggtcttaaaa

SEQ ID NO: 3422 - DNA, 201 bp, Homo sapiens; identical to SEQ ID NO: 3317

SEQ ID NO: 3423 - DNA, 201 bp, Homo sapiens; identical to SEQ ID NO: 3318

SEQ ID NO: 3424 - DNA, 201 bp, Homo sapiens; identical to SEQ ID NO: 3319

SEQ ID NO: 3425 - DNA, 201 bp, Homo sapiens; identical to SEQ ID NO: 3320

SEQ ID NO: 3426 - DNA, 201 bp, Homo sapiens; identical to SEQ ID NO: 3321

SEQ ID NO: 3427 - DNA, 201 bp, Homo sapiens; identical to SEQ ID NO: 3322

SEQ ID NO: 3428 - DNA, 201 bp, Homo sapiens; identical to SEQ ID NO: 3323

SEQ ID NO: 3429 - DNA, 201 bp, Homo sapiens; identical to SEQ ID NO: 3324

SEQ ID NO: 3430 - DNA, 201 bp, Homo sapiens; identical to SEQ ID NO: 3320

SEQ ID NO: 3431 - DNA, 201 bp, Homo sapiens; identical to SEQ ID NO: 3326

SEQ ID NO: 3432 - DNA, 201 bp, Homo sapiens; identical to SEQ ID NO: 3327

SEQ ID NO: 3433 - DNA, 201 bp, Homo sapiens; identical to SEQ ID NO: 3328

SEQ ID NO: 3434 - DNA, 201 bp, Homo sapiens; identical to SEQ ID NO: 3329

SEQ ID NO: 3435 - DNA, 201 bp, Homo sapiens; identical to SEQ ID NO: 3330

SEQ ID NO: 3436 - DNA, 201 bp, Homo sapiens; identical to SEQ ID NO: 3331

SEQ ID NO: 3437 - DNA, 201 bp, Homo sapiens; identical to SEQ ID NO: 3332

SEQ ID NO: 3438 - DNA, 201 bp, Homo sapiens; identical to SEQ ID NO: 3333

SEQ ID NO: 3439 - DNA, 201 bp, Homo sapiens; identical to SEQ ID NO: 3334

SEQ ID NO: 3440 - DNA, 201 bp, Homo sapiens; identical to SEQ ID NO: 3335

SEQ ID NO: 3441 - DNA, 201 bp, Homo sapiens; identical to SEQ ID NO: 3336

SEQ ID NO: 3442 - DNA, 201 bp, Homo sapiens; identical to SEQ ID NO: 3337

SEQ ID NO: 3443 - DNA, 201 bp, Homo sapiens; identical to SEQ ID NO: 3338

SEQ ID NO: 3444 - DNA, 201 bp, Homo sapiens; identical to SEQ ID NO: 3339

SEQ ID NO: 3445 - DNA, 201 bp, Homo sapiens; identical to SEQ ID NO: 3340

SEQ ID NO: 3446 - DNA, 201 bp, Homo sapiens; identical to SEQ ID NO: 3341

SEQ ID NO: 3447 - DNA, 201 bp, Homo sapiens; identical to SEQ ID NO: 3342

SEQ ID NO: 3448 - DNA, 201 bp, Homo sapiens; identical to SEQ ID NO: 3343

SEQ ID NO: 3449 - DNA, 201 bp, Homo sapiens; identical to SEQ ID NO: 3323

SEQ ID NO: 3450 - DNA, 201 bp, Homo sapiens; identical to SEQ ID NO: 3345

SEQ ID NO: 3451 - DNA, 201 bp, Homo sapiens; identical to SEQ ID NO: 3346

SEQ ID NO: 3452 - DNA, 201 bp, Homo sapiens; identical to SEQ ID NO: 3347

SEQ ID NO: 3453 - DNA, 201 bp, Homo sapiens; identical to SEQ ID NO: 3348

SEQ ID NO: 3454 - DNA, 201 bp, Homo sapiens; identical to SEQ ID NO: 3349

SEQ ID NO: 3455 - DNA, 201 bp, Homo sapiens; identical to SEQ ID NO: 3350

SEQ ID NO: 3456 - DNA, 201 bp, Homo sapiens; identical to SEQ ID NO: 3351

SEQ ID NO: 3457 - DNA, 201 bp, Homo sapiens; identical to SEQ ID NO: 3352

SEQ ID NO: 3458 - DNA, 201 bp, Homo sapiens; identical to SEQ ID NO: 3353

SEQ ID NO: 3459 - DNA, 201 bp, Homo sapiens; identical to SEQ ID NO: 3354

SEQ ID NO: 3460 - DNA, 201 bp, Homo sapiens; identical to SEQ ID NO: 3355

SEQ ID NO: 3461 - DNA, 201 bp, Homo sapiens; identical to SEQ ID NO: 3356

SEQ ID NO: 3462 - DNA, 201 bp, Homo sapiens; identical to SEQ ID NO: 3357

SEQ ID NO: 3463 - DNA, 201 bp, Homo sapiens; identical to SEQ ID NO: 3358

SEQ ID NO: 3464 - DNA, 201 bp, Homo sapiens; identical to SEQ ID NO: 3359

SEQ ID NO: 3465 - DNA, 201 bp, Homo sapiens; identical to SEQ ID NO: 3360

SEQ ID NO: 3466 - DNA, 201 bp, Homo sapiens; identical to SEQ ID NO: 3340

SEQ ID NO: 3467 - DNA, 201 bp, Homo sapiens; identical to SEQ ID NO: 3362

SEQ ID NO: 3468 - DNA, 201 bp, Homo sapiens; identical to SEQ ID NO: 3318

SEQ ID NO: 3469 - DNA, 201 bp, Homo sapiens; identical to SEQ ID NO: 3365

SEQ ID NO: 3470 - DNA, 201 bp, Homo sapiens; identical to SEQ ID NO: 3366

SEQ ID NO: 3471 - DNA, 201 bp, Homo sapiens; identical to SEQ ID NO: 3367

SEQ ID NO: 3472 - DNA, 201 bp, Homo sapiens; identical to SEQ ID NO: 3369

SEQ ID NO: 3473 - DNA, 201 bp, Homo sapiens; identical to SEQ ID NO: 3370

SEQ ID NO: 3474 - DNA, 201 bp, Homo sapiens; identical to SEQ ID NO: 3371

SEQ ID NO: 3475 - DNA, 201 bp, Homo sapiens; identical to SEQ ID NO: 3372

SEQ ID NO: 3476 - DNA, 201 bp, Homo sapiens; identical to SEQ ID NO: 3352

SEQ ID NO: 3477 - DNA, 201 bp, Homo sapiens; identical to SEQ ID NO: 3374

SEQ ID NO: 3478 - DNA, 201 bp, Homo sapiens; identical to SEQ ID NO: 3365

SEQ ID NO: 3479 - DNA, 201 bp, Homo sapiens; identical to SEQ ID NO: 3376

SEQ ID NO: 3480 - DNA, 201 bp, Homo sapiens; identical to SEQ ID NO: 3378

SEQ ID NO: 3481 - DNA, 201 bp, Homo sapiens; identical to SEQ ID NO: 3379

SEQ ID NO: 3482 - DNA, 201 bp, Homo sapiens; identical to SEQ ID NO: 3380

SEQ ID NO: 3483 - DNA, 201 bp, Homo sapiens; identical to SEQ ID NO: 3381

SEQ ID NO: 3484 - DNA, 201 bp, Homo sapiens; identical to SEQ ID NO: 3382

SEQ ID NO: 3485 - DNA, 201 bp, Homo sapiens; identical to SEQ ID NO: 3383

SEQ ID NO: 3486 - DNA, 201 bp, Homo sapiens; identical to SEQ ID NO: 3384

SEQ ID NO: 3487 - DNA, 201 bp, Homo sapiens; identical to SEQ ID NO: 3385

SEQ ID NO: 3488 - DNA, 201 bp, Homo sapiens; identical to SEQ ID NO: 3386

SEQ ID NO: 3489 - DNA, 201 bp, Homo sapiens; identical to SEQ ID NO: 3387

SEQ ID NO: 3490 - DNA, 201 bp, Homo sapiens; identical to SEQ ID NO: 3388

SEQ ID NO: 3491 - DNA, 201 bp, Homo sapiens; identical to SEQ ID NO: 3389

SEQ ID NO: 3492 - DNA, 201 bp, Homo sapiens; identical to SEQ ID NO: 3378

SEQ ID NO: 3493 - DNA, 201 bp, Homo sapiens; identical to SEQ ID NO: 3391

SEQ ID NO: 3494 - DNA, 201 bp, Homo sapiens; identical to SEQ ID NO: 3392

SEQ ID NO: 3495 - DNA, 201 bp, Homo sapiens; identical to SEQ ID NO: 3393

SEQ ID NO: 3496 - DNA, 201 bp, Homo sapiens; identical to SEQ ID NO: 3394

SEQ ID NO: 3497 - DNA, 201 bp, Homo sapiens; identical to SEQ ID NO: 3395

SEQ ID NO: 3498 - DNA, 201 bp, Homo sapiens; identical to SEQ ID NO: 3369

SEQ ID NO: 3499 - DNA, 201 bp, Homo sapiens; identical to SEQ ID NO: 3397

SEQ ID NO: 3500 - DNA, 201 bp, Homo sapiens; identical to SEQ ID NO: 3398

SEQ ID NO: 3501 - DNA, 201 bp, Homo sapiens; identical to SEQ ID NO: 3399

SEQ ID NO: 3502 - DNA, 201 bp, Homo sapiens; identical to SEQ ID NO: 3400

SEQ ID NO: 3503 - DNA, 201 bp, Homo sapiens; identical to SEQ ID NO: 3401

SEQ ID NO: 3504 - DNA, 201 bp, Homo sapiens; identical to SEQ ID NO: 3402

SEQ ID NO: 3505 - DNA, 201 bp, Homo sapiens; identical to SEQ ID NO: 3403

SEQ ID NO: 3506 - DNA, 201 bp, Homo sapiens; identical to SEQ ID NO: 3404

SEQ ID NO: 3507 - DNA, 201 bp, Homo sapiens; identical to SEQ ID NO: 3405

SEQ ID NO: 3508 - DNA, 201 bp, Homo sapiens; identical to SEQ ID NO: 3407

SEQ ID NO: 3509 - DNA, 201 bp, Homo sapiens; identical to SEQ ID NO: 3408

SEQ ID NO: 3510 - DNA, 201 bp, Homo sapiens; identical to SEQ ID NO: 3409

SEQ ID NO: 3511 - DNA, 201 bp, Homo sapiens; identical to SEQ ID NO: 3410

SEQ ID NO: 3512 - DNA, 201 bp, Homo sapiens; identical to SEQ ID NO: 3411

SEQ ID NO: 3513 - DNA, 201 bp, Homo sapiens; identical to SEQ ID NO: 3412

SEQ ID NO: 3514 - DNA, 201 bp, Homo sapiens; identical to SEQ ID NO: 3413

SEQ ID NO: 3515 - DNA, 201 bp, Homo sapiens; identical to SEQ ID NO: 3414

SEQ ID NO: 3516 - DNA, 201 bp, Homo sapiens; identical to SEQ ID NO: 3415

SEQ ID NO: 3517 - DNA, 201 bp, Homo sapiens; identical to SEQ ID NO: 3416

SEQ ID NO: 3518 - DNA, 201 bp, Homo sapiens; identical to SEQ ID NO: 3417

SEQ ID NO: 3519 - DNA, 201 bp, Homo sapiens; identical to SEQ ID NO: 3418

SEQ ID NO: 3520 - DNA, 201 bp, Homo sapiens; identical to SEQ ID NO: 3419

SEQ ID NO: 3521 - DNA, 176 bp, Homo sapiens; identical to SEQ ID NO: 3420

SEQ ID NO: 3522 - DNA, 161 bp, Homo sapiens; identical to SEQ ID NO: 3421

SEQ ID NO: 3523 - DNA, 201 bp, Homo sapiens; identical to SEQ ID NO: 3406

SEQ ID NO: 3524 - DNA, 201 bp, Homo sapiens; identical to SEQ ID NO: 3317

SEQ ID NO: 3525 - DNA, 201 bp, Homo sapiens; identical to SEQ ID NO: 3318

SEQ ID NO: 3526 - DNA, 201 bp, Homo sapiens; identical to SEQ ID NO: 3319

SEQ ID NO: 3527 - DNA, 201 bp, Homo sapiens; identical to SEQ ID NO: 3320

SEQ ID NO: 3528 - DNA, 201 bp, Homo sapiens; identical to SEQ ID NO: 3321

SEQ ID NO: 3529 - DNA, 201 bp, Homo sapiens; identical to SEQ ID NO: 3322

SEQ ID NO: 3530 - DNA, 201 bp, Homo sapiens; identical to SEQ ID NO: 3323

SEQ ID NO: 3531 - DNA, 201 bp, Homo sapiens; identical to SEQ ID NO: 3324

SEQ ID NO: 3532 - DNA, 201 bp, Homo sapiens; identical to SEQ ID NO: 3320

SEQ ID NO: 3533 - DNA, 201 bp, Homo sapiens; identical to SEQ ID NO: 3326

SEQ ID NO: 3534 - DNA, 201 bp, Homo sapiens; identical to SEQ ID NO: 3327

SEQ ID NO: 3535 - DNA, 201 bp, Homo sapiens; identical to SEQ ID NO: 3328

SEQ ID NO: 3536 - DNA, 201 bp, Homo sapiens; identical to SEQ ID NO: 3329

SEQ ID NO: 3537 - DNA, 201 bp, Homo sapiens; identical to SEQ ID NO: 3330

SEQ ID NO: 3538 - DNA, 201 bp, Homo sapiens; identical to SEQ ID NO: 3331

SEQ ID NO: 3539 - DNA, 201 bp, Homo sapiens; identical to SEQ ID NO: 3332

SEQ ID NO: 3540 - DNA, 201 bp, Homo sapiens; identical to SEQ ID NO: 3333

SEQ ID NO: 3541 - DNA, 201 bp, Homo sapiens; identical to SEQ ID NO: 3334

SEQ ID NO: 3542 - DNA, 201 bp, Homo sapiens; identical to SEQ ID NO: 3335

SEQ ID NO: 3543 - DNA, 201 bp, Homo sapiens; identical to SEQ ID NO: 3336

SEQ ID NO: 3544 - DNA, 201 bp, Homo sapiens; identical to SEQ ID NO: 3337

SEQ ID NO: 3545 - DNA, 201 bp, Homo sapiens; identical to SEQ ID NO: 3338

SEQ ID NO: 3546 - DNA, 201 bp, Homo sapiens; identical to SEQ ID NO: 3339

SEQ ID NO: 3547 - DNA, 201 bp, Homo sapiens; identical to SEQ ID NO: 3340

SEQ ID NO: 3548 - DNA, 201 bp, Homo sapiens; identical to SEQ ID NO: 3341

SEQ ID NO: 3549 - DNA, 201 bp, Homo sapiens; identical to SEQ ID NO: 3342

SEQ ID NO: 3550 - DNA, 201 bp, Homo sapiens; identical to SEQ ID NO: 3343

SEQ ID NO: 3551 - DNA, 201 bp, Homo sapiens; identical to SEQ ID NO: 3323

SEQ ID NO: 3552 - DNA, 201 bp, Homo sapiens; identical to SEQ ID NO: 3345

SEQ ID NO: 3553 - DNA, 201 bp, Homo sapiens; identical to SEQ ID NO: 3346

SEQ ID NO: 3554 - DNA, 201 bp, Homo sapiens; identical to SEQ ID NO: 3347

SEQ ID NO: 3555 - DNA, 201 bp, Homo sapiens; identical to SEQ ID NO: 3348

SEQ ID NO: 3556 - DNA, 201 bp, Homo sapiens; identical to SEQ ID NO: 3349

SEQ ID NO: 3557 - DNA, 201 bp, Homo sapiens; identical to SEQ ID NO: 3350

SEQ ID NO: 3558 - DNA, 201 bp, Homo sapiens; identical to SEQ ID NO: 3351

SEQ ID NO: 3559 - DNA, 201 bp, Homo sapiens; identical to SEQ ID NO: 3352

SEQ ID NO: 3560 - DNA, 201 bp, Homo sapiens; identical to SEQ ID NO: 3353

SEQ ID NO: 3561 - DNA, 201 bp, Homo sapiens; identical to SEQ ID NO: 3354

SEQ ID NO: 3562 - DNA, 201 bp, Homo sapiens; identical to SEQ ID NO: 3355

SEQ ID NO: 3563 - DNA, 201 bp, Homo sapiens; identical to SEQ ID NO: 3356

SEQ ID NO: 3564 - DNA, 201 bp, Homo sapiens; identical to SEQ ID NO: 3357

SEQ ID NO: 3565 - DNA, 201 bp, Homo sapiens; identical to SEQ ID NO: 3358

SEQ ID NO: 3566 - DNA, 201 bp, Homo sapiens; identical to SEQ ID NO: 3359

SEQ ID NO: 3567 - DNA, 201 bp, Homo sapiens; identical to SEQ ID NO: 3360

SEQ ID NO: 3568 - DNA, 201 bp, Homo sapiens; identical to SEQ ID NO: 3340

SEQ ID NO: 3569 - DNA, 201 bp, Homo sapiens; identical to SEQ ID NO: 3362

SEQ ID NO: 3570 - DNA, 201 bp, Homo sapiens
gtggaaggaagtcaactgaatttccaagaaaaatacgtgaacaggagccagcacgtcgtgtctcaagatctagcttctcttctgaccctgatgagagtgasggaatacctttgaaaagaaggcgtgtgtcctttggtgggcacctaagacctgaactatttgatgaaaacttgcctcctaatacgcctctcaaaaggggag

SEQ ID NO: 3571 - DNA, 201 bp, Homo sapiens; identical to SEQ ID NO: 3318

SEQ ID NO: 3572 - DNA, 201 bp, Homo sapiens; identical to SEQ ID NO: 3365

SEQ ID NO: 3573 - DNA, 201 bp, Homo sapiens; identical to SEQ ID NO: 3366

SEQ ID NO: 3574 - DNA, 201 bp, Homo sapiens; identical to SEQ ID NO: 3367

SEQ ID NO: 3575 - DNA, 201 bp, Homo sapiens; identical to SEQ ID NO: 3369

SEQ ID NO: 3576 - DNA, 201 bp, Homo sapiens; identical to SEQ ID NO: 3370

SEQ ID NO: 3577 - DNA, 201 bp, Homo sapiens; identical to SEQ ID NO: 3371

SEQ ID NO: 3578 - DNA, 201 bp, Homo sapiens; identical to SEQ ID NO: 3372

SEQ ID NO: 3579 - DNA, 201 bp, Homo sapiens; identical to SEQ ID NO: 3352

SEQ ID NO: 3580 - DNA, 201 bp, Homo sapiens; identical to SEQ ID NO: 3374

SEQ ID NO: 3581 - DNA, 201 bp, Homo sapiens; identical to SEQ ID NO: 3365

SEQ ID NO: 3582 - DNA, 201 bp, Homo sapiens; identical to SEQ ID NO: 3376

SEQ ID NO: 3583 - DNA, 201 bp, Homo sapiens; identical to SEQ ID NO: 3378

SEQ ID NO: 3584 - DNA, 201 bp, Homo sapiens; identical to SEQ ID NO: 3379

SEQ ID NO: 3585 - DNA, 201 bp, Homo sapiens; identical to SEQ ID NO: 3380

SEQ ID NO: 3586 - DNA, 201 bp, Homo sapiens; identical to SEQ ID NO: 3381

SEQ ID NO: 3587 - DNA, 201 bp, Homo sapiens; identical to SEQ ID NO: 3382

SEQ ID NO: 3588 - DNA, 201 bp, Homo sapiens; identical to SEQ ID NO: 3383

SEQ ID NO: 3589 - DNA, 201 bp, Homo sapiens; identical to SEQ ID NO: 3384

SEQ ID NO: 3590 - DNA, 201 bp, Homo sapiens; identical to SEQ ID NO: 3385

SEQ ID NO: 3591 - DNA, 201 bp, Homo sapiens; identical to SEQ ID NO: 3386

SEQ ID NO: 3592 - DNA, 201 bp, Homo sapiens; identical to SEQ ID NO: 3387

SEQ ID NO: 3593 - DNA, 201 bp, Homo sapiens; identical to SEQ ID NO: 3388

SEQ ID NO: 3594 - DNA, 201 bp, Homo sapiens; identical to SEQ ID NO: 3389

SEQ ID NO: 3595 - DNA, 201 bp, Homo sapiens; identical to SEQ ID NO: 3378

SEQ ID NO: 3596 - DNA, 201 bp, Homo sapiens
gtaaatgggtctgttattgatgagcctgtacggctaaaacatggagatgtaataactattattgatcgttccttcaggtatgaaaatgaaagtcttcagartggaaggaagtcaactgaatttccaagaaaaatacgtgaacaggagccagcacgtcgtgtctcaagatctagcttctcttctgaccctgatgagagtgac

SEQ ID NO: 3597 - DNA, 201 bp, Homo sapiens; identical to SEQ ID NO: 3392

SEQ ID NO: 3598 - DNA, 201 bp, Homo sapiens; identical to SEQ ID NO: 3393

SEQ ID NO: 3599 - DNA, 201 bp, Homo sapiens; identical to SEQ ID NO: 3394

SEQ ID NO: 3600 - DNA, 201 bp, Homo sapiens; identical to SEQ ID NO: 3395

SEQ ID NO: 3601 - DNA, 201 bp, Homo sapiens; identical to SEQ ID NO: 3369

SEQ ID NO: 3602 - DNA, 201 bp, Homo sapiens; identical to SEQ ID NO: 3397

SEQ ID NO: 3603 - DNA, 201 bp, Homo sapiens; identical to SEQ ID NO: 3398

SEQ ID NO: 3604 - DNA, 201 bp, Homo sapiens; identical to SEQ ID NO: 3399

SEQ ID NO: 3605 - DNA, 201 bp, Homo sapiens; identical to SEQ ID NO: 3400

SEQ ID NO: 3606 - DNA, 201 bp, Homo sapiens; identical to SEQ ID NO: 3401

SEQ ID NO: 3607 - DNA, 201 bp, Homo sapiens; identical to SEQ ID NO: 3402

SEQ ID NO: 3608 - DNA, 201 bp, Homo sapiens; identical to SEQ ID NO: 3403

SEQ ID NO: 3609 - DNA, 201 bp, Homo sapiens; identical to SEQ ID NO: 3404

SEQ ID NO: 3610 - DNA, 201 bp, Homo sapiens; identical to SEQ ID NO: 3405

SEQ ID NO: 3611 - DNA, 201 bp, Homo sapiens; identical to SEQ ID NO: 3406

SEQ ID NO: 3612 - DNA, 201 bp, Homo sapiens; identical to SEQ ID NO: 3407

SEQ ID NO: 3613 - DNA, 201 bp, Homo sapiens; identical to SEQ ID NO: 3408

SEQ ID NO: 3614 - DNA, 201 bp, Homo sapiens; identical to SEQ ID NO: 3409

SEQ ID NO: 3615 - DNA, 201 bp, Homo sapiens; identical to SEQ ID NO: 3410

SEQ ID NO: 3616 - DNA, 201 bp, Homo sapiens; identical to SEQ ID NO: 3411

SEQ ID NO: 3617 - DNA, 201 bp, Homo sapiens; identical to SEQ ID NO: 3412

SEQ ID NO: 3618 - DNA, 201 bp, Homo sapiens; identical to SEQ ID NO: 3413

SEQ ID NO: 3619 - DNA, 201 bp, Homo sapiens; identical to SEQ ID NO: 3414

SEQ ID NO: 3620 - DNA, 201 bp, Homo sapiens; identical to SEQ ID NO: 3415

SEQ ID NO: 3621 - DNA, 201 bp, Homo sapiens; identical to SEQ ID NO: 3416

SEQ ID NO: 3622 - DNA, 201 bp, Homo sapiens; identical to SEQ ID NO: 3417

SEQ ID NO: 3623 - DNA, 201 bp, Homo sapiens; identical to SEQ ID NO: 3418

SEQ ID NO: 3624 - DNA, 201 bp, Homo sapiens; identical to SEQ ID NO: 3419

SEQ ID NO: 3625 - DNA, 176 bp, Homo sapiens; identical to SEQ ID NO: 3420

SEQ ID NO: 3626 - DNA, 161 bp, Homo sapiens; identical to SEQ ID NO: 3421

SEQ ID NO: 3627 - DNA, 201 bp, Homo sapiens
aaaatcaggtacattacaggaatatcagaagagaatgaaaaaactagatcagcagtacaaagagaggatacggaatgcagaactcttcctccagctggaartaataaagaaaagaaggcagcagtgaaagaatttgaagacaagaaggttgagctgaaagagaacctgattgctgagctagaagaaaagaagaaaatgatt

SEQ ID NO: 3628 - DNA, 201 bp, Homo sapiens
tactttcaggcgtattggggggtttgatttactttccttttatttctttattttttgcttatacttgtttttgaaaacctcctctgagtttgaagggacarctatttttattgattatctttaagtctctctaccatggagaagagcaggaagggatacactctccagtgcattttcatgttttgaatctgattagtggat

SEQ ID NO: 3629 - DNA, 201 bp, Homo sapiens
gaagagcaggaagggatacactctccagtgcattttcatgttttgaatctgattagtggatcacgtagctactttccctgtcgcgtccaattcactatttscccagaagcttggggcagaggtcctagcaggagatgatgaattctcgtggctctcggccttctcagagaaataaatgctttgtgtaacatctgtgcacac

SEQ ID NO: 3630 - DNA, 201 bp, Homo sapiens
tatttaatgcaggtgatttattcaaacatttgttctagcttaagctggaataagcagtggtcatttcagaagttttcatttgtaattccttcctctccctygttcccaagtaggtagtagtaagtatgtgccacaggctgattatctgggtaatcttttacgggtgggaggtgagattgatagtgcaataatcagtgatct

SEQ ID NO: 3631 - DNA, 201 bp, Homo sapiens
cccaagcaagttggggggactgtgatgacaattaaatcaccttctctgaagttctggctctgcagagaccaaaccttactgacttgtacagacttgtacargtaaagacttatacagatagatttttgttttaacttacaatccgttttttcctcttttttttttttttttctggtgttggagtcttatttagaaaacagg

SEQ ID NO: 3632 - DNA, 201 bp, Homo sapiens
tttcaatgatcatgtgttttgtcctcctaaacagtataccaaagtttgtttttatagttgaggattgtattgataaccactggggttccgcattgaagcargaacaaattgcctctttttctggccttctctgtgggacctctgcttttgtgaagcaactatttatttgaagaccagggtatgggcacttttgccttctct

SEQ ID NO: 3633 - DNA, 201 bp, Homo sapiens
cagtggtgaccaggaacagaagcagccttcctgttagtagatgggggtacttctgtggtgggcagaagccttactaaaggggaagacagactttgaagttkctagacgagaaggaggctagcttctagcctgggtggccattattccaaaaggtcattgtttctcactagaccccagggcaccagatgaatttccaagttt

SEQ ID NO: 3634 - DNA, 201 bp, Homo sapiens
tggtgggcagaagccttactaaaggggaagacagactttgaagtttctagacgagaaggaggctagcttctagcctgggtggccattattccaaaaggtcrttgtttctcactagaccccagggcaccagatgaatttccaagtttaaactctttcctgcaggtgattactttgaaaaaggttggtccagaccattttgat

SEQ ID NO: 3635 - DNA, 201 bp, Homo sapiens
ctttcctgcaggtgattactttgaaaaaggttggtccagaccattttgatcaagaacctgtatatgtgttgtgttagaggcatctgcctcaagtctatgtrcagtgtttgctgcgggtgtgttccaatattcattttacctctgcttgggggttttgtgtgttcccctccccccatgccctgcctacccccttttccctga

SEQ ID NO: 3636 - DNA, 201 bp, Homo sapiens
aggtgattactttgaaaaaggttggtccagaccattttgatcaagaacctgtatatgtgttgtgttagaggcatctgcctcaagtctatgtacagtgtttkctgcgggtgtgttccaatattcattttacctctgcttgggggttttgtgtgttcccctccccccatgccctgcctacccccttttccctgaaccacgtcc

SEQ ID NO: 3637 - DNA, 201 bp, Homo sapiens
catgcggatactagtatttatagatgtctgactacctaacttaatttttgtttttgaacttctaattggggccagtgtaaggtcgatcccagaggctgatytgcaaatcaagctacatgtatttgtgtataagaccctgtgttcaggactgggtgacttttctaagaaatatggggtttagaatggggttgactgtatttt

SEQ ID NO: 3638 - DNA, 201 bp, Homo sapiens
ctggagagaagattgtattttttacagttttttgggtttggcttccttctcacatttctttagctttgaatttttactaaataaatttcctcctgattaawtttttttttctcatctgggaatttgaaatctcggtgcttactgttacaccaatttgtccaaagagttgaaatcactttaatgccagaacatggtaaattt

SEQ ID NO: 3639 - DNA, 201 bp, Homo sapiens
atttgaaatctcggtgcttactgttacaccaatttgtccaaagagttgaaatcactttaatgccagaacatggtaaatttgcagccatttcaagcaggtgrtggtctttttttataacatcgttaacgggtaccattaaatattctgagaggtgaatgtaaaatataaaaggtataggtttttttttttttttaaagaaaa

SEQ ID NO: 3640 - DNA, 201 bp, Homo sapiens
accaatttgtccaaagagttgaaatcactttaatgccagaacatggtaaatttgcagccatttcaagcaggtgatggtctttttttataacatcgttaacrggtaccattaaatattctgagaggtgaatgtaaaatataaaaggtataggtttttttttttttttaaagaaaacaataaactttcaaagagaaaaccagc

SEQ ID NO: 3641 - DNA, 201 bp, Homo sapiens
ttgcagccatttcaagcaggtgatggtctttttttataacatcgttaacgggtaccattaaatattctgagaggtgaatgtaaaatataaaaggtataggkttttttttttttttaaagaaaacaataaactttcaaagagaaaaccagcatgaagtctgtattgtatccattgacttgataagtgatagaaatttatttt

SEQ ID NO: 3642 - DNA, 201 bp, Homo sapiens
aatataaaaggtataggtttttttttttttttaaagaaaacaataaactttcaaagagaaaaccagcatgaagtctgtattgtatccattgacttgataartgatagaaatttattttaggtttttgatccattgcttatggggaaaggaagttagggcagaggaagggatattctagacatttaattcttagtgaagact

SEQ ID NO: 3643 - DNA, 126 bp, Homo sapiens
atctggggtgttgacccttaaatgtttgtgcactcttcttgttgcagataaaagtcattaaaaatcaagtgaatagaatggatcttgggtggaaaaacaaycttgaaataaacttgtgattgagga

SEQ ID NO: 3644 - DNA, 1 bp, Homo sapiens
r

SEQ ID NO: 3645 - DNA, 201 bp, Homo sapiens
tactttcaggcgtattggggggtttgatttactttccttttatttctttattttttgcttatacttgtttttgaaaacctcctctgagtttgaagggacarctatttttattgattatctttaagtctctctaccatggagaagagcaggaagggatacactctccagtgcattttcattagtggatcacgtagctacttt

SEQ ID NO: 3646 - DNA, 201 bp, Homo sapiens
ctctctaccatggagaagagcaggaagggatacactctccagtgcattttcattagtggatcacgtagctactttccctgtcgcgtccaattcactatttscccagaagcttggggcagaggtcctagcaggagatgatgaattctcgtggctctcggccttctcagagaaataaatgctttgtgtaacatctgtgcacac

SEQ ID NO: 3647 - DNA, 201 bp, Homo sapiens; identical to SEQ ID NO: 3630

SEQ ID NO: 3648 - DNA, 1 bp, Homo sapiens
r

SEQ ID NO: 3649 - DNA, 201 bp, Homo sapiens; identical to SEQ ID NO: 3645

SEQ ID NO: 3650 - DNA, 201 bp, Homo sapiens; identical to SEQ ID NO: 3646

SEQ ID NO: 3651 - DNA, 201 bp, Homo sapiens; identical to SEQ ID NO: 3630

SEQ ID NO: 3652 - DNA, 1 bp, Homo sapiens
r

SEQ ID NO: 3653 - DNA, 201 bp, Homo sapiens; identical to SEQ ID NO: 3628

SEQ ID NO: 3654 - DNA, 201 bp, Homo sapiens; identical to SEQ ID NO: 3629

SEQ ID NO: 3655 - DNA, 201 bp, Homo sapiens; identical to SEQ ID NO: 3630

SEQ ID NO: 3656 - DNA, 201 bp, Homo sapiens; identical to SEQ ID NO: 3631

SEQ ID NO: 3657 - DNA, 201 bp, Homo sapiens; identical to SEQ ID NO: 3632

SEQ ID NO: 3658 - DNA, 201 bp, Homo sapiens; identical to SEQ ID NO: 3633

SEQ ID NO: 3659 - DNA, 201 bp, Homo sapiens; identical to SEQ ID NO: 3634

SEQ ID NO: 3660 - DNA, 201 bp, Homo sapiens; identical to SEQ ID NO: 3635

SEQ ID NO: 3661 - DNA, 201 bp, Homo sapiens; identical to SEQ ID NO: 3636

SEQ ID NO: 3662 - DNA, 201 bp, Homo sapiens; identical to SEQ ID NO: 3637

SEQ ID NO: 3663 - DNA, 201 bp, Homo sapiens; identical to SEQ ID NO: 3638

SEQ ID NO: 3664 - DNA, 201 bp, Homo sapiens; identical to SEQ ID NO: 3639

SEQ ID NO: 3665 - DNA, 201 bp, Homo sapiens; identical to SEQ ID NO: 3640

SEQ ID NO: 3666 - DNA, 201 bp, Homo sapiens; identical to SEQ ID NO: 3641

SEQ ID NO: 3667 - DNA, 201 bp, Homo sapiens; identical to SEQ ID NO: 3642

SEQ ID NO: 3668 - DNA, 126 bp, Homo sapiens; identical to SEQ ID NO: 3643

SEQ ID NO: 3669 - DNA, 201 bp, Homo sapiens
acttgacaatcgagtatcacggaaaggagcacaaagcagatgctactcaggcaagagaagggccttctcgggaaacttctccccgggaagcccctgcatcyggctgggcagccctaggtctttcctacaaagtacagtggccactacatattctcttcaccccagctgtcctggaaaagtacaatgttgtttttaagtact

SEQ ID NO: 3670 - DNA, 201 bp, Homo sapiens
tggatcgcattcgcagcactgtggctgagcatctctggaagttgatggtagaagaatccgatttactgggtcagctgaagatcattaaagacttttacctyctgggacgtggagaactgtttcaggccttcattgacacagctcaacacatgttgaaaacaccacccactgcagtaactgagcatgatgtgaatgtggcct

SEQ ID NO: 3671 - DNA, 201 bp, Homo sapiens
gggcattgggggactgacaggaaaacaactgagagaactgcaggacttgcgcctgattgaggaagagaacatgctggcaccatctctgaagcagttttccstacgagtggagattttgccatcctacattccagtgagggttgctgaaaaaatcctatttgttggagaatctgtccagatgtttgagaatcaaaatgtgaa

SEQ ID NO: 3672 - DNA, 201 bp, Homo sapiens; identical to SEQ ID NO: 3669

SEQ ID NO: 3673 - DNA, 201 bp, Homo sapiens; identical to SEQ ID NO: 3670

SEQ ID NO: 3674 - DNA, 201 bp, Homo sapiens; identical to SEQ ID NO: 3671

SEQ ID NO: 3675 - DNA, 201 bp, Homo sapiens
tataacaaatactatacccaggctggtggaactctgggcagtttcgggatgtgaaaatttctggctcataaattgaaataacagccacgttcccaaggttrtaacagaagattcaaaacatcccattctagccacacacaaataaatatctgcggcttagtgataggactctaccttttctcctagaagcagttactgaac

SEQ ID NO: 3676 - DNA, 201 bp, Homo sapiens
cctgtaatcccagctactcaggaggctgagacaggagaattgcttgaacctgggaagcagacgctgcagtgagctgagattgtgccattgcattccagccygggcaacaagagcgaaattccgtctcaaaaaaaaaaaaaaaaaaaaaaagtattattctccaagaaaaaggtccttaagaaaaaattgagatcaagttgt

SEQ ID NO: 3677 - DNA, 201 bp, Homo sapiens
tatagtcactgcatctggttttcatcactacatattctacacacactgggaagctctgacaacttattccctgctattatcaactaaagatcaccctttcyactgctgtctctggagcaggagctggcaaactatggcctgctgtctgtttttgtacagttttactgaaacacagccgtgcccatttgtttactcattgtc

SEQ ID NO: 3678 - DNA, 201 bp, Homo sapiens
tatcaactaaagatcaccctttccactgctgtctctggagcaggagctggcaaactatggcctgctgtctgtttttgtacagttttactgaaacacagccrtgcccatttgtttactcattgtctatggttgctttcatgccctcacagcaaaggcgagtagttgtgatggatcaaatggcccacaaagcctgaaatattt

SEQ ID NO: 3679 - DNA, 201 bp, Homo sapiens
cctcagaggtcaaaggccagaggaccctttgccaccagagtgagatcctagagaccatcatcctggtaaatcccagtgcagacagcatcagctctgaggtwcatcatcttcttagcagctcatcagcttataaactactaatcttgagtgggcaaagtttagagcctgggggagacctcatcctacagagtggcacctact

SEQ ID NO: 3680 - DNA, 201 bp, Homo sapiens
tggaagagaaccaccaaactcaggagcaggagagcctagtgcaggaggataaaaccaggaaaccaaagatgctagaggaaaaatccccagaaaaggtcaasgccatggaagagaagttagaagctcttctggagaagaccaaagctctgggcctggaagagagcctagtgcaggagggcagggccagagagcaggaagaaa

SEQ ID NO: 3681 - DNA, 201 bp, Homo sapiens
ggataaaaccaggaaaccaaagatgctagaggaaaaatccccagaaaaggtcaaggccatggaagagaagttagaagctcttctggagaagaccaaagctstgggcctggaagagagcctagtgcaggagggcagggccagagagcaggaagaaaagtactggagggggcaggatgtggtccaggagtggcaagaaacatc

SEQ ID NO: 3682 - DNA, 201 bp, Homo sapiens
tccctctctgtcctcagcgtgccctccccagacactgccaaccaagagcctacccccaagtctccctgtggcctgacagaacagtacctacacaaagaccrttggccagaggtatctccagaagacacccagtcactttctctgtcagaagagagtcccagcaaggagacctccctggatgtctcttctaagcagctctct

SEQ ID NO: 3683 - DNA, 201 bp, Homo sapiens
gctgtgcctaccaacctcaagcccagcaaaatcaaacagcgggctgatagcaaggagagcctcaaagccactaccaagacggccgtgagcaagttggccamacgggaggaggtggtagaagagggagccaaggaggcacgttcagagctggccaaggagttagccaagacagagaagaaggcaaaagagtcatctgagaag

SEQ ID NO: 3684 - DNA, 201 bp, Homo sapiens
atatcctgaccgaagcctctctcctgaagatgcagaatccctctctgtcctcagcgtgccctccccagacactgccaaccaagagcctacccccaagtctycctgtggcctgacagaacagtacctacacaaagaccgttggccagaggtatctccagaagacacccagtcactttctctgtcagaagagagtcccagcaa

SEQ ID NO: 3685 - DNA, 201 bp, Homo sapiens
ggggcgagtagggcgcagggccccaggcaaggccaagccagcgtcccctgcacggcgtctggatcttcggggaaaacgctcacccacccctggtaaagggyctgcagatcgagcatcccgggccccacctcgaccacgcagcaccacaagccaggtcaccccagcagaggaaaaggatggacacagccccatgtccaaagg

SEQ ID NO: 3686 - DNA, 201 bp, Homo sapiens
gctgaggagacagtcaagccagggcctgaagagggcacactagagaaggaagagaaagttcctcctcccaggagcccccaggcccaggaagcacctgtcarcattgatgaggggcttacaggctgtaccattcaactgttgccagcacaggataaagcaatagtctttgagattatggaggcaggagagcccacaggccca

SEQ ID NO: 3687 - DNA, 201 bp, Homo sapiens
cctgccccagccaaggctgaaaatgaagaggctgcggcttgccctgcctgggaacgtggggcctggcctgaaggagctgagaggagctcccggcctgacayattgctctcccctgagcagccagtgtgtcctgcagggggctccgggggcccacccagcagtgcctctcctgaggtcgaagctgggccccagggatgtgcc

SEQ ID NO: 3688 - DNA, 201 bp, Homo sapiens
gtggtactcaccaccccaggcctggccatgacccacctcctctcccacagccagacccccgcccatcccctccccgccctgatgtgtgcatggctgacccygaggggctcagctcagagtctgggagagtagagaggctacgggagaaggaaaaggttcaggggcgagtagggcgcagggccccaggcaaggccaagccag

SEQ ID NO: 3689 - DNA, 201 bp, Homo sapiens
accttcaggaaatgggaagtacttacctggggcgatcacaagccctgatgaacacattctgacacctgatagctccttctccaagagtcctgagtctttgmcaggccctgccttggaggacattgccataaagtgggaagataaagttccagggttgaaagacagaacctcagaacagaagaaggaacctgagccaaagga

SEQ ID NO: 3690 - DNA, 201 bp, Homo sapiens
agagcaggaagaaaagtactggagggggcaggatgtggtccaggagtggcaagaaacatctcctaccagagaggagccggctggagaacagaaagagcttrccccggcatgggaggacacatctcctgagcaggacaataggtattggaggggcagagaggatgtggccttggaacaggacacatactggagggagctaag

SEQ ID NO: 3691 - DNA, 201 bp, Homo sapiens
ccttggaacaggacacatactggagggagctaagctgtgagcggaaggtctggttccctcacgagctggatggccagggggcccgcccacactacactgargaacgggaaagcactttcctagatgagggcccagatgatgagcaagaagtacccctgcgggaacacgcaacccggagcccctgggcctcagacttcaagg

SEQ ID NO: 3692 - DNA, 201 bp, Homo sapiens
tagccctcccttggactcacacctggggcctgcccgacccagtctggacttccctgcttcagcctttggcttctcctcattgcagccagctcccccacagmtgccctctccagctgaaccccgctcggcaccctgtggctcccttgccttctctggggatcgagctctggctctggctccaggaccccccaccagaacccg

SEQ ID NO: 3693 - DNA, 201 bp, Homo sapiens
actcagagactgagcagaccatctcagatgaggagatccatgatgagccggaggagcgcccagctccacccagatttcatacaagtacatatgacctgccygggcctgaaggtgctggcccattcgaagccagccaacctgccgatagtgctgttcctgctacctctggcaaagtctatggaacgccagagactgaactca

SEQ ID NO: 3694 - DNA, 201 bp, Homo sapiens
acagagacctagaacagacagacaaagcccctgaacagaaacaccaggcccaggaacaaaaggataaagtctcagaaaagaaggatcaggccttagaacamaaatactgggctttgggacagaaggatgaagccctggaacaaaacattcaggctctggaagagaaccaccaaactcaggagcaggagagcctagtgcagg

SEQ ID NO: 3695 - DNA, 201 bp, Homo sapiens
gccctgatgtgtgcatggctgaccccgaggggctcagctcagagtctgggagagtagagaggctacgggagaaggaaaaggttcaggggcgagtagggcgyagggccccaggcaaggccaagccagcgtcccctgcacggcgtctggatcttcggggaaaacgctcacccacccctggtaaagggcctgcagatcgagcat

SEQ ID NO: 3696 - DNA, 201 bp, Homo sapiens
gaggggctcagctcagagtctgggagagtagagaggctacgggagaaggaaaaggttcaggggcgagtagggcgcagggccccaggcaaggccaagccagygtcccctgcacggcgtctggatcttcggggaaaacgctcacccacccctggtaaagggcctgcagatcgagcatcccgggccccacctcgaccacgcagc

SEQ ID NO: 3697 - DNA, 201 bp, Homo sapiens
aggtattggaggggcagagaggatgtggccttggaacaggacacatactggagggagctaagctgtgagcggaaggtctggttccctcacgagctggatgkccagggggcccgcccacactacactgaggaacgggaaagcactttcctagatgagggcccagatgatgagcaagaagtacccctgcgggaacacgcaacc

SEQ ID NO: 3698 - DNA, 201 bp, Homo sapiens
tctccccagctcctggtccccccacacctgccccggaatcccatactcctgcacccttctcttggggcacagccgagtatgacagtgtggtggctgcagtrcaggagggggcagctgagttggaaggtgggccatactcccccctggggaaggactaccgcaaggctgaaggggaaagggaagaagaaggtagggctgagg

SEQ ID NO: 3699 - DNA, 201 bp, Homo sapiens
ccctctctgtcctcagcgtgccctccccagacactgccaaccaagagcctacccccaagtctccctgtggcctgacagaacagtacctacacaaagaccgktggccagaggtatctccagaagacacccagtcactttctctgtcagaagagagtcccagcaaggagacctccctggatgtctcttctaagcagctctctc

SEQ ID NO: 3700 - DNA, 201 bp, Homo sapiens
aaagatgctagaggaaaaatccccagaaaaggtcaaggccatggaagagaagttagaagctcttctggagaagaccaaagctctgggcctggaagagagcytagtgcaggagggcagggccagagagcaggaagaaaagtactggagggggcaggatgtggtccaggagtggcaagaaacatctcctaccagagaggagcc

SEQ ID NO: 3701 - DNA, 201 bp, Homo sapiens
ccctcatggctggctgacatcccaccctgggtgcccaaggacagacccctcccccctgcacccctctccccagctcctggtccccccacacctgccccggmatcccatactcctgcacccttctcttggggcacagccgagtatgacagtgtggtggctgcagtgcaggagggggcagctgagttggaaggtgggccatac

SEQ ID NO: 3702 - DNA, 201 bp, Homo sapiens
tcaagccagggcctgaagagggcacactagagaaggaagagaaagttcctcctcccaggagcccccaggcccaggaagcacctgtcaacattgatgagggrcttacaggctgtaccattcaactgttgccagcacaggataaagcaatagtctttgagattatggaggcaggagagcccacaggcccaattctgggagcag

SEQ ID NO: 3703 - DNA, 201 bp, Homo sapiens
caaagccactaccaagacggccgtgagcaagttggccaaacgggaggaggtggtagaagagggagccaaggaggcacgttcagagctggccaaggagttakccaagacagagaagaaggcaaaagagtcatctgagaagcccccagagaagcctgccaagcctgagagggtgaagacagagtcaagtgaggcactgaaggc

SEQ ID NO: 3704 - DNA, 201 bp, Homo sapiens
gcctagtcaatggactcaaggcaggaccaatggccttgagttccaagggcagctctggtgcccctgtatatgtggatctcgcctacatcccgaatcattgsagtggcaagactgctgaccttgacttcttccgtcgagtgcgtgcatcctactatgtggtcagtgggaatgaccctgccaatggcgagccaagccgggctg

SEQ ID NO: 3705 - DNA, 201 bp, Homo sapiens
cgtgagcaagttggccaaacgggaggaggtggtagaagagggagccaaggaggcacgttcagagctggccaaggagttagccaagacagagaagaaggcamaagagtcatctgagaagcccccagagaagcctgccaagcctgagagggtgaagacagagtcaagtgaggcactgaaggcagagaagcgaaagctgatcaa

SEQ ID NO: 3706 - DNA, 201 bp, Homo sapiens
cagtgaagatggcttctcctccaccatctggcccacccagtgccacccacacaccctttcatcagtccccagtggaagaaaagtctgagccccaagacttycaggaggcagactcctggggagacactaagcgcacaccaggtgtgggcaaagaagatgctgctgaggagacagtcaagccagggcctgaagagggcacac

SEQ ID NO: 3707 - DNA, 201 bp, Homo sapiens
agtgaagatggcttctcctccaccatctggcccacccagtgccacccacacaccctttcatcagtccccagtggaagaaaagtctgagccccaagactttmaggaggcagactcctggggagacactaagcgcacaccaggtgtgggcaaagaagatgctgctgaggagacagtcaagccagggcctgaagagggcacact

SEQ ID NO: 3708 - DNA, 201 bp, Homo sapiens
ttggccctagctccagctccaagcctgcctggagacatgggtgatggcatcctgccgtgccacctggagtgctcagaggcagccacggagaagccaagccycttccaggttccctctgaggattgtgcagccaatggcccaactgaaaccagccctaaccccccaggccctgccccagccaaggctgaaaatgaagaggct

SEQ ID NO: 3709 - DNA, 201 bp, Homo sapiens
tacctctggcaaagtctatggaacgccagagactgaactcacctaccccactaacatagtggctgcccctttggctgaagaggaacatgtgtcctcggccrcttcaatcactgagtgtgacaaactttcttcctttgccacatcagtggctgaggaccaatctgtggcctcacttacagctccccagacagaggagacagg

SEQ ID NO: 3710 - DNA, 201 bp, Homo sapiens
gcatggctgaccccgaggggctcagctcagagtctgggagagtagagaggctacgggagaaggaaaaggttcaggggcgagtagggcgcagggccccaggyaaggccaagccagcgtcccctgcacggcgtctggatcttcggggaaaacgctcacccacccctggtaaagggcctgcagatcgagcatcccgggccccac

SEQ ID NO: 3711 - DNA, 201 bp, Homo sapiens
caaggagagcctcaaagccactaccaagacggccgtgagcaagttggccaaacgggaggaggtggtagaagagggagccaaggaggcacgttcagagctgkccaaggagttagccaagacagagaagaaggcaaaagagtcatctgagaagcccccagagaagcctgccaagcctgagagggtgaagacagagtcaagtga

SEQ ID NO: 3712 - DNA, 201 bp, Homo sapiens
agaccaaagctctgggcctggaagagagcctagtgcaggagggcagggccagagagcaggaagaaaagtactggagggggcaggatgtggtccaggagtgkcaagaaacatctcctaccagagaggagccggctggagaacagaaagagcttgccccggcatgggaggacacatctcctgagcaggacaataggtattgga

SEQ ID NO: 3713 - DNA, 201 bp, Homo sapiens
caggaccaatggccttgagttccaagggcagctctggtgcccctgtatatgtggatctcgcctacatcccgaatcattgcagtggcaagactgctgacctwgacttcttccgtcgagtgcgtgcatcctactatgtggtcagtgggaatgaccctgccaatggcgagccaagccgggctgtgctggatgccctgctggagg

SEQ ID NO: 3714 - DNA, 201 bp, Homo sapiens
aaggccagaggaccctttgccaccagagtgagatcctagagaccatcatcctggtaaatcccagtgcagacagcatcagctctgaggttcatcatcttctkagcagctcatcagcttataaactactaatcttgagtgggcaaagtttagagcctgggggagacctcatcctacagagtggcacctactcatatgaaaact

SEQ ID NO: 3715 - DNA, 201 bp, Homo sapiens
gcagctcatcagcttataaactactaatcttgagtgggcaaagtttagagcctgggggagacctcatcctacagagtggcacctactcatatgaaaacttkgcccaggtccttcacaaccccgagatttcccaattgctcagcaatagagaccctgggatacaggccttccttaccgtgtcctgcttaggggaaggtgatt

SEQ ID NO: 3716 - DNA, 201 bp, Homo sapiens
gacaaggtagggaaaaagcaccttaaagaaaagatatcaaagctggaagaaaaaaaagacaaggagaaaaaagagatcaaaaaggagaggaaagagctcargaaggatgaaggaaggaaggaggagaagaaggatgccaagaaggaggagaagaggaaagataccaaacctgagctcaagaagatttccaagccagaccta

SEQ ID NO: 3717 - DNA, 201 bp, Homo sapiens
ctggggcccctctcctctccaatctgccacgacctgcctcaccagccctgtctgagggctcctcctctgaggctaccacgcctgtgatttcaagtgtggcrgagcgcttctctccaagccttgaggctgcagaacaggagtctggagagctggacccaggaatggaaccagctgcccacagcctctgggacctcactcctc

SEQ ID NO: 3718 - DNA, 201 bp, Homo sapiens
gctgaccccgaggggctcagctcagagtctgggagagtagagaggctacgggagaaggaaaaggttcaggggcgagtagggcgcagggccccaggcaaggmcaagccagcgtcccctgcacggcgtctggatcttcggggaaaacgctcacccacccctggtaaagggcctgcagatcgagcatcccgggccccacctcga

SEQ ID NO: 3719 - DNA, 201 bp, Homo sapiens
cagagaggagccggctggagaacagaaagagcttgccccggcatgggaggacacatctcctgagcaggacaataggtattggaggggcagagaggatgtgkccttggaacaggacacatactggagggagctaagctgtgagcggaaggtctggttccctcacgagctggatggccagggggcccgcccacactacactga

SEQ ID NO: 3720 - DNA, 201 bp, Homo sapiens
agagaaggagctttcatctcctatctcacccaagagcctccagtctgacactccaaccttcagctatgcagccctggcaggacccactgtacccccaaggmcagagccagggccaagtatggagcccagcctcaccccacctgcagttcccccccgtgctcctatcctgagcaaaggcccaagcccccctcttaatggtaa

SEQ ID NO: 3721 - DNA, 201 bp, Homo sapiens
gccctctccagctgaaccccgctcggcaccctgtggctcccttgccttctctggggatcgagctctggctctggctccaggaccccccaccagaacccggyatgatgaatacctggaagtgaccaaggcccccagcctggattcctcactgccccagctcccatcacccagttctcctggggcccctctcctctccaatct

SEQ ID NO: 3722 - DNA, 201 bp, Homo sapiens
gttgctacatcttcccaggtggtcgtggggactctgccctctttgctgtcaatggtttcaacatcctggtggatggtggctctgatcgcaagtcctgtttktggaagctggtacggcacttggaccgcattgactcggtgctactcacacacattggggcagacaacctgccaggcatcaatggactactgcagcgcaaag

SEQ ID NO: 3723 - DNA, 201 bp, Homo sapiens
tgtctcttctaagcagctctctccagaaagccttggcaccctccagtttggggaactaaaccttgggaaggaagaaatggggcatctgatgcaggccgagratacctctcaccacacagctcccatgtctgttccagagccccatgcagccacagcgtcacctcccacagatgggacaactcgatactctgcacagacaga

SEQ ID NO: 3724 - DNA, 201 bp, Homo sapiens
tctcttctaagcagctctctccagaaagccttggcaccctccagtttggggaactaaaccttgggaaggaagaaatggggcatctgatgcaggccgaggayacctctcaccacacagctcccatgtctgttccagagccccatgcagccacagcgtcacctcccacagatgggacaactcgatactctgcacagacagaca

SEQ ID NO: 3725 - DNA, 201 bp, Homo sapiens
tgagatcatctcccctccagcttccccacctgagatggttggacaaagggttccttcagccccaggacaagagagtcctatcccagaccctaagctcatgscacacatgaagaatgaacccactactccctcatggctggctgacatcccaccctgggtgcccaaggacagacccctcccccctgcacccctctccccagc

SEQ ID NO: 3726 - DNA, 201 bp, Homo sapiens
caaggacagacccctcccccctgcacccctctccccagctcctggtccccccacacctgccccggaatcccatactcctgcacccttctcttggggcacasccgagtatgacagtgtggtggctgcagtgcaggagggggcagctgagttggaaggtgggccatactcccccctggggaaggactaccgcaaggctgaagg

SEQ ID NO: 3727 - DNA, 201 bp, Homo sapiens
tggggaaggactaccgcaaggctgaaggggaaagggaagaagaaggtagggctgaggctcctgacaaaagctcacacagctcaaaggtaccagaggccagsaaaagccatgccaccacggagcctgagcagactgagccggagcagagagagcccacaccctatcctgatgagagaagctttcagtatgcagacatctatg

SEQ ID NO: 3728 - DNA, 201 bp, Homo sapiens
cgcagggccccaggcaaggccaagccagcgtcccctgcacggcgtctggatcttcggggaaaacgctcacccacccctggtaaagggcctgcagatcgagyatcccgggccccacctcgaccacgcagcaccacaagccaggtcaccccagcagaggaaaaggatggacacagccccatgtccaaaggcctagtcaatgga

SEQ ID NO: 3729 - DNA, 201 bp, Homo sapiens
cccgtactgaagctacgcagggcttggactatgtgccatcagctggtaccatctcacccacctcctcactggaagaagacaagggcttcaaatcaccaccmtgtgaggacttctctgtgactggggagtcagagaagagaggagagatcatagggaaaggcttgtctggagagagagctgtggaagaggaagaggaggaga

SEQ ID NO: 3730 - DNA, 201 bp, Homo sapiens
gtggtccaggagtggcaagaaacatctcctaccagagaggagccggctggagaacagaaagagcttgccccggcatgggaggacacatctcctgagcaggmcaataggtattggaggggcagagaggatgtggccttggaacaggacacatactggagggagctaagctgtgagcggaaggtctggttccctcacgagctg

SEQ ID NO: 3731 - DNA, 201 bp, Homo sapiens
gggagctaagctgtgagcggaaggtctggttccctcacgagctggatggccagggggcccgcccacactacactgaggaacgggaaagcactttcctagakgagggcccagatgatgagcaagaagtacccctgcgggaacacgcaacccggagcccctgggcctcagacttcaaggatttccaggaatcctcaccacaga

SEQ ID NO: 3732 - DNA, 201 bp, Homo sapiens
agcccccaggcccaggaagcacctgtcaacattgatgaggggcttacaggctgtaccattcaactgttgccagcacaggataaagcaatagtctttgagaytatggaggcaggagagcccacaggcccaattctgggagcagaagcccttcccggaggtttgaggactttaccccaagaacctggcaaacctcagaaagat

SEQ ID NO: 3733 - DNA, 201 bp, Homo sapiens
gaaccagctgcccacagcctctgggacctcactcctctgagcccagcacccccagcttcactggacttggccctagctccagctccaagcctgcctggagwcatgggtgatggcatcctgccgtgccacctggagtgctcagaggcagccacggagaagccaagccccttccaggttccctctgaggattgtgcagccaat

SEQ ID NO: 3734 - DNA, 201 bp, Homo sapiens
ccaggagtggcaagaaacatctcctaccagagaggagccggctggagaacagaaagagcttgccccggcatgggaggacacatctcctgagcaggacaatmggtattggaggggcagagaggatgtggccttggaacaggacacatactggagggagctaagctgtgagcggaaggtctggttccctcacgagctggatgg

SEQ ID NO: 3735 - DNA, 201 bp, Homo sapiens
ccaagagcctccagtctgacactccaaccttcagctatgcagccctggcaggacccactgtacccccaaggccagagccagggccaagtatggagcccagmctcaccccacctgcagttcccccccgtgctcctatcctgagcaaaggcccaagcccccctcttaatggtaacatcctgagctgcagcccagataggaggt

SEQ ID NO: 3736 - DNA, 201 bp, Homo sapiens
taccaaacctgagctcaagaagatttccaagccagacctaaagccctttactcctgaggtacgtaagaccctctataaagccaaggtccctggaagagtcmaaatagacaggagccgtgctatccgtggggagaaggagctgtcttctgagccccagacacccccagcccagaagggaactgtaccactcccaaccatcag

SEQ ID NO: 3737 - DNA, 201 bp, Homo sapiens
ggccctggaaccaaaagacaaagacttagaagaaaaagacaaggccctggaacagaaggataagattccagaagagaaagacaaagccttagaacaaaagratacagccctggaacagaaggacaaggccctggaaccaaaagataaagacttggaacaaaaggacagggtcctagaacagaaggagaagatcccagaaga

SEQ ID NO: 3738 - DNA, 201 bp, Homo sapiens
agaagaaaaagacaaggccctggaacagaaggataagattccagaagagaaagacaaagccttagaacaaaaggatacagccctggaacagaaggacaagrccctggaaccaaaagataaagacttggaacaaaaggacagggtcctagaacagaaggagaagatcccagaagagaaagacaaagccttagatcaaaaagt

SEQ ID NO: 3739 - DNA, 201 bp, Homo sapiens
ggcacagccgagtatgacagtgtggtggctgcagtgcaggagggggcagctgagttggaaggtgggccatactcccccctggggaaggactaccgcaaggytgaaggggaaagggaagaagaaggtagggctgaggctcctgacaaaagctcacacagctcaaaggtaccagaggccagcaaaagccatgccaccacggag

SEQ ID NO: 3740 - DNA, 201 bp, Homo sapiens
cagcccagataggaggtccccatcccccaaggaatcaggccggagtcactgggatgacagcactagtgactcagaactggagaagggggctcgggaacagscagaaaaagaggcccaatccccaagtcctcctcaccccattcctatggggtcccccacattatggccagaaactgaggcacatgttagccctcccttgga

SEQ ID NO: 3741 - DNA, 201 bp, Homo sapiens
caagccagcgtcccctgcacggcgtctggatcttcggggaaaacgctcacccacccctggtaaagggcctgcagatcgagcatcccgggccccacctcgaycacgcagcaccacaagccaggtcaccccagcagaggaaaaggatggacacagccccatgtccaaaggcctagtcaatggactcaaggcaggaccaatggc

SEQ ID NO: 3742 - DNA, 201 bp, Homo sapiens
gcccagataggaggtccccatcccccaaggaatcaggccggagtcactgggatgacagcactagtgactcagaactggagaagggggctcgggaacagccmgaaaaagaggcccaatccccaagtcctcctcaccccattcctatggggtcccccacattatggccagaaactgaggcacatgttagccctcccttggact

SEQ ID NO: 3743 - DNA, 201 bp, Homo sapiens
tggggctgtgcctaccaacctcaagcccagcaaaatcaaacagcgggctgatagcaaggagagcctcaaagccactaccaagacggccgtgagcaagttgkccaaacgggaggaggtggtagaagagggagccaaggaggcacgttcagagctggccaaggagttagccaagacagagaagaaggcaaaagagtcatctga

SEQ ID NO: 3744 - DNA, 201 bp, Homo sapiens
gtgaagatggcttctcctccaccatctggcccacccagtgccacccacacaccctttcatcagtccccagtggaagaaaagtctgagccccaagactttcmggaggcagactcctggggagacactaagcgcacaccaggtgtgggcaaagaagatgctgctgaggagacagtcaagccagggcctgaagagggcacacta

SEQ ID NO: 3745 - DNA, 201 bp, Homo sapiens
ctgcagatcgagcatcccgggccccacctcgaccacgcagcaccacaagccaggtcaccccagcagaggaaaaggatggacacagccccatgtccaaaggmctagtcaatggactcaaggcaggaccaatggccttgagttccaagggcagctctggtgcccctgtatatgtggatctcgcctacatcccgaatcattgca

SEQ ID NO: 3746 - DNA, 201 bp, Homo sapiens
cttgggctgggctaaatgggaggggttgtccctccccatcatccattcctgtgaggtgtctcaaaccaaagttaacagggagaggatgggggaggggacamattagaataggatagcatctgatgcctgagaaccctctcctagcactgtcaaatgctggtattgaatggggactgaggatgggtctcagagagcaacctc

SEQ ID NO: 3747 - DNA, 201 bp, Homo sapiens
ggatgggtctcagagagcaacctcctccctcgtagagggagattatatccccaactccagggacctctttatctcaatctatttatttggcatcctgggarggatttccaatagtaatttatgtgacctggggcaggataccgtcagtgaggtgcccagagctgcaccctttcctccatttcccatcccccatctcctcaa

SEQ ID NO: 3748 - DNA, 201 bp, Homo sapiens
aaacccgctcttggacagaggatctgggaggtggaagccaggccagaggacttggggaaaatgagatggaggaaggaaaaagggagaagctgagccacagsttaactcctacagagtgaaatgaaaacgggctgaaaataccaccccaggagaggacctcgccccaagcaagccagtgagcagccctgccagactactgcc

SEQ ID NO: 3749 - DNA, 201 bp, Homo sapiens; identical to SEQ ID NO: 3679

SEQ ID NO: 3750 - DNA, 201 bp, Homo sapiens; identical to SEQ ID NO: 3680

SEQ ID NO: 3751 - DNA, 201 bp, Homo sapiens; identical to SEQ ID NO: 3681

SEQ ID NO: 3752 - DNA, 201 bp, Homo sapiens; identical to SEQ ID NO: 3682

SEQ ID NO: 3753 - DNA, 201 bp, Homo sapiens; identical to SEQ ID NO: 3683

SEQ ID NO: 3754 - DNA, 201 bp, Homo sapiens; identical to SEQ ID NO: 3684

SEQ ID NO: 3755 - DNA, 201 bp, Homo sapiens; identical to SEQ ID NO: 3685

SEQ ID NO: 3756 - DNA, 201 bp, Homo sapiens; identical to SEQ ID NO: 3686

SEQ ID NO: 3757 - DNA, 201 bp, Homo sapiens; identical to SEQ ID NO: 3687

SEQ ID NO: 3758 - DNA, 201 bp, Homo sapiens; identical to SEQ ID NO: 3688

SEQ ID NO: 3759 - DNA, 201 bp, Homo sapiens; identical to SEQ ID NO: 3689

SEQ ID NO: 3760 - DNA, 201 bp, Homo sapiens; identical to SEQ ID NO: 3690

SEQ ID NO: 3761 - DNA, 201 bp, Homo sapiens; identical to SEQ ID NO: 3691

SEQ ID NO: 3762 - DNA, 201 bp, Homo sapiens; identical to SEQ ID NO: 3692

SEQ ID NO: 3763 - DNA, 201 bp, Homo sapiens; identical to SEQ ID NO: 3693

SEQ ID NO: 3764 - DNA, 201 bp, Homo sapiens; identical to SEQ ID NO: 3694

SEQ ID NO: 3765 - DNA, 201 bp, Homo sapiens; identical to SEQ ID NO: 3695

SEQ ID NO: 3766 - DNA, 201 bp, Homo sapiens; identical to SEQ ID NO: 3696

SEQ ID NO: 3767 - DNA, 201 bp, Homo sapiens; identical to SEQ ID NO: 3697

SEQ ID NO: 3768 - DNA, 201 bp, Homo sapiens; identical to SEQ ID NO: 3698

SEQ ID NO: 3769 - DNA, 201 bp, Homo sapiens; identical to SEQ ID NO: 3699

SEQ ID NO: 3770 - DNA, 201 bp, Homo sapiens; identical to SEQ ID NO: 3700

SEQ ID NO: 3771 - DNA, 201 bp, Homo sapiens; identical to SEQ ID NO: 3701

SEQ ID NO: 3772 - DNA, 201 bp, Homo sapiens; identical to SEQ ID NO: 3702

SEQ ID NO: 3773 - DNA, 201 bp, Homo sapiens; identical to SEQ ID NO: 3703

SEQ ID NO: 3774 - DNA, 201 bp, Homo sapiens; identical to SEQ ID NO: 3704

SEQ ID NO: 3775 - DNA, 201 bp, Homo sapiens; identical to SEQ ID NO: 3705

SEQ ID NO: 3776 - DNA, 201 bp, Homo sapiens; identical to SEQ ID NO: 3706

SEQ ID NO: 3777 - DNA, 201 bp, Homo sapiens; identical to SEQ ID NO: 3707

SEQ ID NO: 3778 - DNA, 201 bp, Homo sapiens; identical to SEQ ID NO: 3708

SEQ ID NO: 3779 - DNA, 201 bp, Homo sapiens; identical to SEQ ID NO: 3709

SEQ ID NO: 3780 - DNA, 201 bp, Homo sapiens; identical to SEQ ID NO: 3710

SEQ ID NO: 3781 - DNA, 201 bp, Homo sapiens; identical to SEQ ID NO: 3711

SEQ ID NO: 3782 - DNA, 201 bp, Homo sapiens; identical to SEQ ID NO: 3712

SEQ ID NO: 3783 - DNA, 201 bp, Homo sapiens; identical to SEQ ID NO: 3713

SEQ ID NO: 3784 - DNA, 201 bp, Homo sapiens; identical to SEQ ID NO: 3714

SEQ ID NO: 3785 - DNA, 201 bp, Homo sapiens; identical to SEQ ID NO: 3715

SEQ ID NO: 3786 - DNA, 201 bp, Homo sapiens; identical to SEQ ID NO: 3716

SEQ ID NO: 3787 - DNA, 201 bp, Homo sapiens; identical to SEQ ID NO: 3717

SEQ ID NO: 3788 - DNA, 201 bp, Homo sapiens; identical to SEQ ID NO: 3718

SEQ ID NO: 3789 - DNA, 201 bp, Homo sapiens; identical to SEQ ID NO: 3719

SEQ ID NO: 3790 - DNA, 201 bp, Homo sapiens; identical to SEQ ID NO: 3720

SEQ ID NO: 3791 - DNA, 201 bp, Homo sapiens; identical to SEQ ID NO: 3721

SEQ ID NO: 3792 - DNA, 201 bp, Homo sapiens; identical to SEQ ID NO: 3722

SEQ ID NO: 3793 - DNA, 201 bp, Homo sapiens; identical to SEQ ID NO: 3723

SEQ ID NO: 3794 - DNA, 201 bp, Homo sapiens; identical to SEQ ID NO: 3724

SEQ ID NO: 3795 - DNA, 201 bp, Homo sapiens; identical to SEQ ID NO: 3725

SEQ ID NO: 3796 - DNA, 201 bp, Homo sapiens; identical to SEQ ID NO: 3726

SEQ ID NO: 3797 - DNA, 201 bp, Homo sapiens; identical to SEQ ID NO: 3727

SEQ ID NO: 3798 - DNA, 201 bp, Homo sapiens; identical to SEQ ID NO: 3728

SEQ ID NO: 3799 - DNA, 201 bp, Homo sapiens; identical to SEQ ID NO: 3729

SEQ ID NO: 3800 - DNA, 201 bp, Homo sapiens; identical to SEQ ID NO: 3730

SEQ ID NO: 3801 - DNA, 201 bp, Homo sapiens; identical to SEQ ID NO: 3731

SEQ ID NO: 3802 - DNA, 201 bp, Homo sapiens; identical to SEQ ID NO: 3732

SEQ ID NO: 3803 - DNA, 201 bp, Homo sapiens; identical to SEQ ID NO: 3733

SEQ ID NO: 3804 - DNA, 201 bp, Homo sapiens; identical to SEQ ID NO: 3734

SEQ ID NO: 3805 - DNA, 201 bp, Homo sapiens; identical to SEQ ID NO: 3735

SEQ ID NO: 3806 - DNA, 201 bp, Homo sapiens; identical to SEQ ID NO: 3736

SEQ ID NO: 3807 - DNA, 201 bp, Homo sapiens; identical to SEQ ID NO: 3737

SEQ ID NO: 3808 - DNA, 201 bp, Homo sapiens; identical to SEQ ID NO: 3738

SEQ ID NO: 3809 - DNA, 201 bp, Homo sapiens; identical to SEQ ID NO: 3739

SEQ ID NO: 3810 - DNA, 201 bp, Homo sapiens; identical to SEQ ID NO: 3740

SEQ ID NO: 3811 - DNA, 201 bp, Homo sapiens; identical to SEQ ID NO: 3741

SEQ ID NO: 3812 - DNA, 201 bp, Homo sapiens; identical to SEQ ID NO: 3742

SEQ ID NO: 3813 - DNA, 201 bp, Homo sapiens; identical to SEQ ID NO: 3743

SEQ ID NO: 3814 - DNA, 201 bp, Homo sapiens; identical to SEQ ID NO: 3744

SEQ ID NO: 3815 - DNA, 201 bp, Homo sapiens; identical to SEQ ID NO: 3745

SEQ ID NO: 3816 - DNA, 201 bp, Homo sapiens; identical to SEQ ID NO: 3746

SEQ ID NO: 3817 - DNA, 201 bp, Homo sapiens; identical to SEQ ID NO: 3747

SEQ ID NO: 3818 - DNA, 201 bp, Homo sapiens; identical to SEQ ID NO: 3748

SEQ ID NO: 3819 - DNA, 201 bp, Homo sapiens; identical to SEQ ID NO: 3679

SEQ ID NO: 3820 - DNA, 201 bp, Homo sapiens; identical to SEQ ID NO: 3680

SEQ ID NO: 3821 - DNA, 201 bp, Homo sapiens; identical to SEQ ID NO: 3681

SEQ ID NO: 3822 - DNA, 201 bp, Homo sapiens; identical to SEQ ID NO: 3682

SEQ ID NO: 3823 - DNA, 201 bp, Homo sapiens; identical to SEQ ID NO: 3683

SEQ ID NO: 3824 - DNA, 201 bp, Homo sapiens; identical to SEQ ID NO: 3684

SEQ ID NO: 3825 - DNA, 201 bp, Homo sapiens; identical to SEQ ID NO: 3685

SEQ ID NO: 3826 - DNA, 201 bp, Homo sapiens; identical to SEQ ID NO: 3686

SEQ ID NO: 3827 - DNA, 201 bp, Homo sapiens; identical to SEQ ID NO: 3687

SEQ ID NO: 3828 - DNA, 201 bp, Homo sapiens; identical to SEQ ID NO: 3688

SEQ ID NO: 3829 - DNA, 201 bp, Homo sapiens; identical to SEQ ID NO: 3689

SEQ ID NO: 3830 - DNA, 201 bp, Homo sapiens; identical to SEQ ID NO: 3690

SEQ ID NO: 3831 - DNA, 201 bp, Homo sapiens; identical to SEQ ID NO: 3691

SEQ ID NO: 3832 - DNA, 201 bp, Homo sapiens; identical to SEQ ID NO: 3692

SEQ ID NO: 3833 - DNA, 201 bp, Homo sapiens; identical to SEQ ID NO: 3693

SEQ ID NO: 3834 - DNA, 201 bp, Homo sapiens; identical to SEQ ID NO: 3694

SEQ ID NO: 3835 - DNA, 201 bp, Homo sapiens; identical to SEQ ID NO: 3695

SEQ ID NO: 3836 - DNA, 201 bp, Homo sapiens; identical to SEQ ID NO: 3696

SEQ ID NO: 3837 - DNA, 201 bp, Homo sapiens; identical to SEQ ID NO: 3697

SEQ ID NO: 3838 - DNA, 201 bp, Homo sapiens; identical to SEQ ID NO: 3698

SEQ ID NO: 3839 - DNA, 201 bp, Homo sapiens; identical to SEQ ID NO: 3699

SEQ ID NO: 3840 - DNA, 201 bp, Homo sapiens; identical to SEQ ID NO: 3700

SEQ ID NO: 3841 - DNA, 201 bp, Homo sapiens; identical to SEQ ID NO: 3701

SEQ ID NO: 3842 - DNA, 201 bp, Homo sapiens; identical to SEQ ID NO: 3702

SEQ ID NO: 3843 - DNA, 201 bp, Homo sapiens; identical to SEQ ID NO: 3703

SEQ ID NO: 3844 - DNA, 201 bp, Homo sapiens; identical to SEQ ID NO: 3704

SEQ ID NO: 3845 - DNA, 201 bp, Homo sapiens; identical to SEQ ID NO: 3705

SEQ ID NO: 3846 - DNA, 201 bp, Homo sapiens; identical to SEQ ID NO: 3706

SEQ ID NO: 3847 - DNA, 201 bp, Homo sapiens; identical to SEQ ID NO: 3707

SEQ ID NO: 3848 - DNA, 201 bp, Homo sapiens; identical to SEQ ID NO: 3708

SEQ ID NO: 3849 - DNA, 201 bp, Homo sapiens; identical to SEQ ID NO: 3709

SEQ ID NO: 3850 - DNA, 201 bp, Homo sapiens; identical to SEQ ID NO: 3710

SEQ ID NO: 3851 - DNA, 201 bp, Homo sapiens; identical to SEQ ID NO: 3711

SEQ ID NO: 3852 - DNA, 201 bp, Homo sapiens; identical to SEQ ID NO: 3712

SEQ ID NO: 3853 - DNA, 201 bp, Homo sapiens; identical to SEQ ID NO: 3713

SEQ ID NO: 3854 - DNA, 201 bp, Homo sapiens; identical to SEQ ID NO: 3714

SEQ ID NO: 3855 - DNA, 201 bp, Homo sapiens; identical to SEQ ID NO: 3715

SEQ ID NO: 3856 - DNA, 201 bp, Homo sapiens; identical to SEQ ID NO: 3716

SEQ ID NO: 3857 - DNA, 201 bp, Homo sapiens; identical to SEQ ID NO: 3717

SEQ ID NO: 3858 - DNA, 201 bp, Homo sapiens; identical to SEQ ID NO: 3718

SEQ ID NO: 3859 - DNA, 201 bp, Homo sapiens; identical to SEQ ID NO: 3719

SEQ ID NO: 3860 - DNA, 201 bp, Homo sapiens; identical to SEQ ID NO: 3720

SEQ ID NO: 3861 - DNA, 201 bp, Homo sapiens; identical to SEQ ID NO: 3721

SEQ ID NO: 3862 - DNA, 201 bp, Homo sapiens; identical to SEQ ID NO: 3722

SEQ ID NO: 3863 - DNA, 201 bp, Homo sapiens; identical to SEQ ID NO: 3723

SEQ ID NO: 3864 - DNA, 201 bp, Homo sapiens; identical to SEQ ID NO: 3724

SEQ ID NO: 3865 - DNA, 201 bp, Homo sapiens; identical to SEQ ID NO: 3725

SEQ ID NO: 3866 - DNA, 201 bp, Homo sapiens; identical to SEQ ID NO: 3726

SEQ ID NO: 3867 - DNA, 201 bp, Homo sapiens; identical to SEQ ID NO: 3727

SEQ ID NO: 3868 - DNA, 201 bp, Homo sapiens; identical to SEQ ID NO: 3728

SEQ ID NO: 3869 - DNA, 201 bp, Homo sapiens; identical to SEQ ID NO: 3729

SEQ ID NO: 3870 - DNA, 201 bp, Homo sapiens; identical to SEQ ID NO: 3730

SEQ ID NO: 3871 - DNA, 201 bp, Homo sapiens; identical to SEQ ID NO: 3731

SEQ ID NO: 3872 - DNA, 201 bp, Homo sapiens; identical to SEQ ID NO: 3732

SEQ ID NO: 3873 - DNA, 201 bp, Homo sapiens; identical to SEQ ID NO: 3733

SEQ ID NO: 3874 - DNA, 201 bp, Homo sapiens; identical to SEQ ID NO: 3734

SEQ ID NO: 3875 - DNA, 201 bp, Homo sapiens; identical to SEQ ID NO: 3735

SEQ ID NO: 3876 - DNA, 201 bp, Homo sapiens; identical to SEQ ID NO: 3736

SEQ ID NO: 3877 - DNA, 201 bp, Homo sapiens; identical to SEQ ID NO: 3737

SEQ ID NO: 3878 - DNA, 201 bp, Homo sapiens; identical to SEQ ID NO: 3738

SEQ ID NO: 3879 - DNA, 201 bp, Homo sapiens; identical to SEQ ID NO: 3739

SEQ ID NO: 3880 - DNA, 201 bp, Homo sapiens; identical to SEQ ID NO: 3740

SEQ ID NO: 3881 - DNA, 201 bp, Homo sapiens; identical to SEQ ID NO: 3741

SEQ ID NO: 3882 - DNA, 201 bp, Homo sapiens; identical to SEQ ID NO: 3742

SEQ ID NO: 3883 - DNA, 201 bp, Homo sapiens; identical to SEQ ID NO: 3743

SEQ ID NO: 3884 - DNA, 201 bp, Homo sapiens; identical to SEQ ID NO: 3744

SEQ ID NO: 3885 - DNA, 201 bp, Homo sapiens; identical to SEQ ID NO: 3745

SEQ ID NO: 3886 - DNA, 201 bp, Homo sapiens; identical to SEQ ID NO: 3746

SEQ ID NO: 3887 - DNA, 201 bp, Homo sapiens; identical to SEQ ID NO: 3747

SEQ ID NO: 3888 - DNA, 201 bp, Homo sapiens; identical to SEQ ID NO: 3748

SEQ ID NO: 3889 - DNA, 186 bp, Homo sapiens
gccagaggaccctttgccaccagagtgagatcctagagaccatcatcctggtaaatcccagtgcagacagcatcagctctgaggtwcatcatcttcttagcagctcatcagcttataaactactaatcttgagtgggcaaagtttagagcctgggggagacctcatcctacagagtggcacctact

SEQ ID NO: 3890 - DNA, 201 bp, Homo sapiens; identical to SEQ ID NO: 3680

SEQ ID NO: 3891 - DNA, 201 bp, Homo sapiens; identical to SEQ ID NO: 3681

SEQ ID NO: 3892 - DNA, 201 bp, Homo sapiens; identical to SEQ ID NO: 3682

SEQ ID NO: 3893 - DNA, 201 bp, Homo sapiens; identical to SEQ ID NO: 3683

SEQ ID NO: 3894 - DNA, 201 bp, Homo sapiens; identical to SEQ ID NO: 3684

SEQ ID NO: 3895 - DNA, 201 bp, Homo sapiens; identical to SEQ ID NO: 3685

SEQ ID NO: 3896 - DNA, 201 bp, Homo sapiens; identical to SEQ ID NO: 3686

SEQ ID NO: 3897 - DNA, 201 bp, Homo sapiens; identical to SEQ ID NO: 3687

SEQ ID NO: 3898 - DNA, 201 bp, Homo sapiens; identical to SEQ ID NO: 3688

SEQ ID NO: 3899 - DNA, 201 bp, Homo sapiens; identical to SEQ ID NO: 3689

SEQ ID NO: 3900 - DNA, 201 bp, Homo sapiens; identical to SEQ ID NO: 3690

SEQ ID NO: 3901 - DNA, 201 bp, Homo sapiens; identical to SEQ ID NO: 3691

SEQ ID NO: 3902 - DNA, 201 bp, Homo sapiens; identical to SEQ ID NO: 3692

SEQ ID NO: 3903 - DNA, 201 bp, Homo sapiens; identical to SEQ ID NO: 3693

SEQ ID NO: 3904 - DNA, 201 bp, Homo sapiens; identical to SEQ ID NO: 3694

SEQ ID NO: 3905 - DNA, 201 bp, Homo sapiens; identical to SEQ ID NO: 3695

SEQ ID NO: 3906 - DNA, 201 bp, Homo sapiens; identical to SEQ ID NO: 3696

SEQ ID NO: 3907 - DNA, 201 bp, Homo sapiens; identical to SEQ ID NO: 3697

SEQ ID NO: 3908 - DNA, 201 bp, Homo sapiens; identical to SEQ ID NO: 3698

SEQ ID NO: 3909 - DNA, 201 bp, Homo sapiens; identical to SEQ ID NO: 3699

SEQ ID NO: 3910 - DNA, 201 bp, Homo sapiens; identical to SEQ ID NO: 3700

SEQ ID NO: 3911 - DNA, 201 bp, Homo sapiens; identical to SEQ ID NO: 3701

SEQ ID NO: 3912 - DNA, 201 bp, Homo sapiens; identical to SEQ ID NO: 3702

SEQ ID NO: 3913 - DNA, 201 bp, Homo sapiens; identical to SEQ ID NO: 3703

SEQ ID NO: 3914 - DNA, 201 bp, Homo sapiens; identical to SEQ ID NO: 3704

SEQ ID NO: 3915 - DNA, 201 bp, Homo sapiens; identical to SEQ ID NO: 3705

SEQ ID NO: 3916 - DNA, 201 bp, Homo sapiens; identical to SEQ ID NO: 3706

SEQ ID NO: 3917 - DNA, 201 bp, Homo sapiens; identical to SEQ ID NO: 3707

SEQ ID NO: 3918 - DNA, 201 bp, Homo sapiens; identical to SEQ ID NO: 3708

SEQ ID NO: 3919 - DNA, 201 bp, Homo sapiens; identical to SEQ ID NO: 3709

SEQ ID NO: 3920 - DNA, 201 bp, Homo sapiens; identical to SEQ ID NO: 3710

SEQ ID NO: 3921 - DNA, 201 bp, Homo sapiens; identical to SEQ ID NO: 3711

SEQ ID NO: 3922 - DNA, 201 bp, Homo sapiens; identical to SEQ ID NO: 3712

SEQ ID NO: 3923 - DNA, 201 bp, Homo sapiens; identical to SEQ ID NO: 3713

SEQ ID NO: 3924 - DNA, 198 bp, Homo sapiens
gccagaggaccctttgccaccagagtgagatcctagagaccatcatcctggtaaatcccagtgcagacagcatcagctctgaggttcatcatcttctkagcagctcatcagcttataaactactaatcttgagtgggcaaagtttagagcctgggggagacctcatcctacagagtggcacctactcatatgaaaact

SEQ ID NO: 3925 - DNA, 201 bp, Homo sapiens; identical to SEQ ID NO: 3715

SEQ ID NO: 3926 - DNA, 201 bp, Homo sapiens; identical to SEQ ID NO: 3716

SEQ ID NO: 3927 - DNA, 201 bp, Homo sapiens; identical to SEQ ID NO: 3717

SEQ ID NO: 3928 - DNA, 201 bp, Homo sapiens; identical to SEQ ID NO: 3718

SEQ ID NO: 3929 - DNA, 201 bp, Homo sapiens; identical to SEQ ID NO: 3719

SEQ ID NO: 3930 - DNA, 201 bp, Homo sapiens; identical to SEQ ID NO: 3720

SEQ ID NO: 3931 - DNA, 201 bp, Homo sapiens; identical to SEQ ID NO: 3721

SEQ ID NO: 3932 - DNA, 201 bp, Homo sapiens; identical to SEQ ID NO: 3722

SEQ ID NO: 3933 - DNA, 201 bp, Homo sapiens; identical to SEQ ID NO: 3723

SEQ ID NO: 3934 - DNA, 201 bp, Homo sapiens; identical to SEQ ID NO: 3724

SEQ ID NO: 3935 - DNA, 201 bp, Homo sapiens; identical to SEQ ID NO: 3725

SEQ ID NO: 3936 - DNA, 201 bp, Homo sapiens; identical to SEQ ID NO: 3726

SEQ ID NO: 3937 - DNA, 201 bp, Homo sapiens; identical to SEQ ID NO: 3727

SEQ ID NO: 3938 - DNA, 201 bp, Homo sapiens; identical to SEQ ID NO: 3728

SEQ ID NO: 3939 - DNA, 201 bp, Homo sapiens; identical to SEQ ID NO: 3729

SEQ ID NO: 3940 - DNA, 201 bp, Homo sapiens; identical to SEQ ID NO: 3730

SEQ ID NO: 3941 - DNA, 201 bp, Homo sapiens; identical to SEQ ID NO: 3731

SEQ ID NO: 3942 - DNA, 201 bp, Homo sapiens; identical to SEQ ID NO: 3732

SEQ ID NO: 3943 - DNA, 201 bp, Homo sapiens; identical to SEQ ID NO: 3733

SEQ ID NO: 3944 - DNA, 201 bp, Homo sapiens; identical to SEQ ID NO: 3734

SEQ ID NO: 3945 - DNA, 201 bp, Homo sapiens; identical to SEQ ID NO: 3735

SEQ ID NO: 3946 - DNA, 201 bp, Homo sapiens; identical to SEQ ID NO: 3736

SEQ ID NO: 3947 - DNA, 201 bp, Homo sapiens; identical to SEQ ID NO: 3737

SEQ ID NO: 3948 - DNA, 201 bp, Homo sapiens; identical to SEQ ID NO: 3738

SEQ ID NO: 3949 - DNA, 201 bp, Homo sapiens; identical to SEQ ID NO: 3739

SEQ ID NO: 3950 - DNA, 201 bp, Homo sapiens; identical to SEQ ID NO: 3740

SEQ ID NO: 3951 - DNA, 201 bp, Homo sapiens; identical to SEQ ID NO: 3741

SEQ ID NO: 3952 - DNA, 201 bp, Homo sapiens; identical to SEQ ID NO: 3742

SEQ ID NO: 3953 - DNA, 201 bp, Homo sapiens; identical to SEQ ID NO: 3743

SEQ ID NO: 3954 - DNA, 201 bp, Homo sapiens; identical to SEQ ID NO: 3744

SEQ ID NO: 3955 - DNA, 201 bp, Homo sapiens; identical to SEQ ID NO: 3745

SEQ ID NO: 3956 - DNA, 201 bp, Homo sapiens; identical to SEQ ID NO: 3746

SEQ ID NO: 3957 - DNA, 201 bp, Homo sapiens; identical to SEQ ID NO: 3747

SEQ ID NO: 3958 - DNA, 201 bp, Homo sapiens; identical to SEQ ID NO: 3748

SEQ ID NO: 3959 - DNA, 201 bp, Homo sapiens
ctcctacaccccagggccagaggaccctttgccaccagagtgagatcctagagaccatcatcctggtaaatcccagtgcagacagcatcagctctgaggtwcatcatcttcttagcagctcatcagcttataaactactaatcttgagtgggcaaagtttagagcctgggggagacctcatcctacagagtggcacctact

SEQ ID NO: 3960 - DNA, 201 bp, Homo sapiens; identical to SEQ ID NO: 3680

SEQ ID NO: 3961 - DNA, 201 bp, Homo sapiens; identical to SEQ ID NO: 3681

SEQ ID NO: 3962 - DNA, 201 bp, Homo sapiens; identical to SEQ ID NO: 3682

SEQ ID NO: 3963 - DNA, 201 bp, Homo sapiens; identical to SEQ ID NO: 3683

SEQ ID NO: 3964 - DNA, 201 bp, Homo sapiens; identical to SEQ ID NO: 3684

SEQ ID NO: 3965 - DNA, 201 bp, Homo sapiens; identical to SEQ ID NO: 3685

SEQ ID NO: 3966 - DNA, 201 bp, Homo sapiens; identical to SEQ ID NO: 3686

SEQ ID NO: 3967 - DNA, 201 bp, Homo sapiens; identical to SEQ ID NO: 3687

SEQ ID NO: 3968 - DNA, 201 bp, Homo sapiens; identical to SEQ ID NO: 3688

SEQ ID NO: 3969 - DNA, 201 bp, Homo sapiens; identical to SEQ ID NO: 3689

SEQ ID NO: 3970 - DNA, 201 bp, Homo sapiens; identical to SEQ ID NO: 3690

SEQ ID NO: 3971 - DNA, 201 bp, Homo sapiens; identical to SEQ ID NO: 3691

SEQ ID NO: 3972 - DNA, 201 bp, Homo sapiens; identical to SEQ ID NO: 3692

SEQ ID NO: 3973 - DNA, 201 bp, Homo sapiens; identical to SEQ ID NO: 3693

SEQ ID NO: 3974 - DNA, 201 bp, Homo sapiens; identical to SEQ ID NO: 3694

SEQ ID NO: 3975 - DNA, 201 bp, Homo sapiens; identical to SEQ ID NO: 3695

SEQ ID NO: 3976 - DNA, 201 bp, Homo sapiens; identical to SEQ ID NO: 3696

SEQ ID NO: 3977 - DNA, 201 bp, Homo sapiens; identical to SEQ ID NO: 3697

SEQ ID NO: 3978 - DNA, 201 bp, Homo sapiens; identical to SEQ ID NO: 3698

SEQ ID NO: 3979 - DNA, 201 bp, Homo sapiens; identical to SEQ ID NO: 3699

SEQ ID NO: 3980 - DNA, 201 bp, Homo sapiens; identical to SEQ ID NO: 3700

SEQ ID NO: 3981 - DNA, 201 bp, Homo sapiens; identical to SEQ ID NO: 3701

SEQ ID NO: 3982 - DNA, 201 bp, Homo sapiens; identical to SEQ ID NO: 3702

SEQ ID NO: 3983 - DNA, 201 bp, Homo sapiens; identical to SEQ ID NO: 3703

SEQ ID NO: 3984 - DNA, 201 bp, Homo sapiens; identical to SEQ ID NO: 3704

SEQ ID NO: 3985 - DNA, 201 bp, Homo sapiens; identical to SEQ ID NO: 3705

SEQ ID NO: 3986 - DNA, 201 bp, Homo sapiens; identical to SEQ ID NO: 3706

SEQ ID NO: 3987 - DNA, 201 bp, Homo sapiens; identical to SEQ ID NO: 3707

SEQ ID NO: 3988 - DNA, 201 bp, Homo sapiens; identical to SEQ ID NO: 3708

SEQ ID NO: 3989 - DNA, 201 bp, Homo sapiens; identical to SEQ ID NO: 3709

SEQ ID NO: 3990 - DNA, 201 bp, Homo sapiens; identical to SEQ ID NO: 3710

SEQ ID NO: 3991 - DNA, 201 bp, Homo sapiens; identical to SEQ ID NO: 3711

SEQ ID NO: 3992 - DNA, 201 bp, Homo sapiens; identical to SEQ ID NO: 3712

SEQ ID NO: 3993 - DNA, 201 bp, Homo sapiens; identical to SEQ ID NO: 3713

SEQ ID NO: 3994 - DNA, 201 bp, Homo sapiens
agggccagaggaccctttgccaccagagtgagatcctagagaccatcatcctggtaaatcccagtgcagacagcatcagctctgaggttcatcatcttctkagcagctcatcagcttataaactactaatcttgagtgggcaaagtttagagcctgggggagacctcatcctacagagtggcacctactcatatgaaaact

SEQ ID NO: 3995 - DNA, 201 bp, Homo sapiens; identical to SEQ ID NO: 3715

SEQ ID NO: 3996 - DNA, 201 bp, Homo sapiens; identical to SEQ ID NO: 3716

SEQ ID NO: 3997 - DNA, 201 bp, Homo sapiens; identical to SEQ ID NO: 3717

SEQ ID NO: 3998 - DNA, 201 bp, Homo sapiens; identical to SEQ ID NO: 3718

SEQ ID NO: 3999 - DNA, 201 bp, Homo sapiens; identical to SEQ ID NO: 3719

SEQ ID NO: 4000 - DNA, 201 bp, Homo sapiens; identical to SEQ ID NO: 3720

SEQ ID NO: 4001 - DNA, 201 bp, Homo sapiens; identical to SEQ ID NO: 3721

SEQ ID NO: 4002 - DNA, 201 bp, Homo sapiens; identical to SEQ ID NO: 3722

SEQ ID NO: 4003 - DNA, 201 bp, Homo sapiens; identical to SEQ ID NO: 3723

SEQ ID NO: 4004 - DNA, 201 bp, Homo sapiens; identical to SEQ ID NO: 3724

SEQ ID NO: 4005 - DNA, 201 bp, Homo sapiens; identical to SEQ ID NO: 3725

SEQ ID NO: 4006 - DNA, 201 bp, Homo sapiens; identical to SEQ ID NO: 3726

SEQ ID NO: 4007 - DNA, 201 bp, Homo sapiens; identical to SEQ ID NO: 3727

SEQ ID NO: 4008 - DNA, 201 bp, Homo sapiens; identical to SEQ ID NO: 3728

SEQ ID NO: 4009 - DNA, 201 bp, Homo sapiens; identical to SEQ ID NO: 3729

SEQ ID NO: 4010 - DNA, 201 bp, Homo sapiens; identical to SEQ ID NO: 3730

SEQ ID NO: 4011 - DNA, 201 bp, Homo sapiens; identical to SEQ ID NO: 3731

SEQ ID NO: 4012 - DNA, 201 bp, Homo sapiens; identical to SEQ ID NO: 3732

SEQ ID NO: 4013 - DNA, 201 bp, Homo sapiens; identical to SEQ ID NO: 3733

SEQ ID NO: 4014 - DNA, 201 bp, Homo sapiens; identical to SEQ ID NO: 3734

SEQ ID NO: 4015 - DNA, 201 bp, Homo sapiens; identical to SEQ ID NO: 3735

SEQ ID NO: 4016 - DNA, 201 bp, Homo sapiens; identical to SEQ ID NO: 3736

SEQ ID NO: 4017 - DNA, 201 bp, Homo sapiens; identical to SEQ ID NO: 3737

SEQ ID NO: 4018 - DNA, 201 bp, Homo sapiens; identical to SEQ ID NO: 3738

SEQ ID NO: 4019 - DNA, 201 bp, Homo sapiens; identical to SEQ ID NO: 3739

SEQ ID NO: 4020 - DNA, 201 bp, Homo sapiens; identical to SEQ ID NO: 3740

SEQ ID NO: 4021 - DNA, 201 bp, Homo sapiens; identical to SEQ ID NO: 3741

SEQ ID NO: 4022 - DNA, 201 bp, Homo sapiens; identical to SEQ ID NO: 3742

SEQ ID NO: 4023 - DNA, 201 bp, Homo sapiens; identical to SEQ ID NO: 3743

SEQ ID NO: 4024 - DNA, 201 bp, Homo sapiens; identical to SEQ ID NO: 3744

SEQ ID NO: 4025 - DNA, 201 bp, Homo sapiens; identical to SEQ ID NO: 3745

SEQ ID NO: 4026 - DNA, 201 bp, Homo sapiens; identical to SEQ ID NO: 3746

SEQ ID NO: 4027 - DNA, 201 bp, Homo sapiens; identical to SEQ ID NO: 3747

SEQ ID NO: 4028 - DNA, 201 bp, Homo sapiens; identical to SEQ ID NO: 3748

SEQ ID NO: 4029 - DNA, 201 bp, Homo sapiens
gtgggcgaaggggccgcccaccttctcggaccactggaaccagagaaacagctgtgcctggccccttgggcatagaggacatttcacctaacttgtcaccrgatgataaatccttcagccgtgtcgtgccccgagtgccagactccaccagacgaacagatgtgggtgctggtgctttgcgtcgtagtgactctccagaaa

SEQ ID NO: 4030 - DNA, 201 bp, Homo sapiens
taaggccttgattgaaaggcccagccaaaataacataggaatccaaaccatggagtgttccttgagggtcccagaaactgtttcagcagcaacccagactrtaaagaatgtgtgtgagcaggggaccagtacagtggaccagaactttggaaagcaagatgccacagttcagactgagagggggagtggtgagaaaccagt

SEQ ID NO: 4031 - DNA, 201 bp, Homo sapiens
agtcgctccatagccagggagaagaagagtttgatatgcctcagcctccacatggccatgtcttacatcgtcacatgagaacaatccgggaagtacgcacrcttgtcactcgtgtcattacagatgtgtattatgtggatggaacagaagtagaaagaaaagtaactgaggagactgaagagccaattgtagagtgtcagg

SEQ ID NO: 4032 - DNA, 201 bp, Homo sapiens
agctcagatgcagaggcccagaagctggggaagccctctgcccatgcctcacaaagcttctgtgaaagttctagtgaaaccccatttcatttcactttgcytaaagaaggtgatatcatcccaccattgactggtgcaaccccacctcttattgggcacctaaaattggagcccaagagacacagtactcctattggtatt

SEQ ID NO: 4033 - DNA, 201 bp, Homo sapiens
gaaatccctgagacaccttgtgaaagtcaaggagaggaactcaaagaagaaaatatggagagtgttccgttgcacctttctctgactgaaactcagtcccragggttgtgtcttcaaaaggaaatgccaaaaaaagaatgctcagaagctatggaagttgaaaccagtgtgattagtattgattcccctcaaaagttggca

SEQ ID NO: 4034 - DNA, 201 bp, Homo sapiens
cagggtctgaggtggaagaaatccctgagacaccttgtgaaagtcaaggagaggaactcaaagaagaaaatatggagagtgttccgttgcacctttctctkactgaaactcagtcccaagggttgtgtcttcaaaaggaaatgccaaaaaaagaatgctcagaagctatggaagttgaaaccagtgtgattagtattgatt

SEQ ID NO: 4035 - DNA, 201 bp, Homo sapiens
tgcttcccagaagatggtcatacaagggccatccagtcctcaaggagaggcaatggtgacagatgtgctagaagaccagaaagaaggacggagtactaatmaggaaaatcctagtaaggccttgattgaaaggcccagccaaaataacataggaatccaaaccatggagtgttccttgagggtcccagaaactgtttcagc

SEQ ID NO: 4036 - DNA, 201 bp, Homo sapiens
agcaagaagggagacaagataagccaatggacacgtcagtgttatctgaagaaggaggagagccttttcagaagaaacttcaaagtggtgaaccagtggarttagaaaacccccctctcctgcctgagtccactgtatcaccacaagcctcaacaccaatatctcagagcacaccagtcttccctcctgggtcacttccta

SEQ ID NO: 4037 - DNA, 201 bp, Homo sapiens
ctactccttcaagggaggaaggtgggtgttctttggcttccactcctgccaccactctgcatctcctgcagctctctggtcagaggtcccttgttcaggasagtctttccacgaattcttcagatcttgttgctccttctcctgatgctttccgatctactccttttatcgttcctagcagtcccacagagcaagaaggga

SEQ ID NO: 4038 - DNA, 201 bp, Homo sapiens
catgtgctgagaatagattagacaccaaggaagaaaagagtgtagaatatgaaggagatctgaaatcagggactgcagaaacagaacctgtagagcaagaytcttcacagccttccttacctttagtgagagcagatgatcctttaagacttgaccaggagttgcagcagccccaaactcaggagaaaacaagtaattcat

SEQ ID NO: 4039 - DNA, 201 bp, Homo sapiens
tggtgctttgcgtcgtagtgactctccagaaattcctttccaggctgctgctggcccttctgatggcttagatgcctcctctccaggaaatagctttgtakggctccgtgttgtagccaagtggtcatccaatggctacttttactctgggaaaatcacacgagatgtcggagctgggaagtataaattgctctttgatga

SEQ ID NO: 4040 - DNA, 201 bp, Homo sapiens
actggaaccagagaaacagctgtgcctggccccttgggcatagaggacatttcacctaacttgtcaccagatgataaatccttcagccgtgtcgtgccccragtgccagactccaccagacgaacagatgtgggtgctggtgctttgcgtcgtagtgactctccagaaattcctttccaggctgctgctggcccttctgat

SEQ ID NO: 4041 - DNA, 201 bp, Homo sapiens
tagatgcctcctctccaggaaatagctttgtagggctccgtgttgtagccaagtggtcatccaatggctacttttactctgggaaaatcacacgagatgtyggagctgggaagtataaattgctctttgatgatgggtacgaatgtgatgtgttgggcaaagacattctgttatgtgaccccatcccgctggacactgaag

SEQ ID NO: 4042 - DNA, 201 bp, Homo sapiens
tcacagaaagtcctcgtgcctccatgggagttctctcaggcaaaagaaaacttatcacttctgaagaggaacggtcccctgccaagcgaggtcgcaagtcwgccacagtaaaacctggtgcagtaggggcaggagagtttgtgagcccctgtgagagtggagacaacaccggtgaaccctctgccctggaagagcagagag

SEQ ID NO: 4043 - DNA, 201 bp, Homo sapiens
ctcggaccactggaaccagagaaacagctgtgcctggccccttgggcatagaggacatttcacctaacttgtcaccagatgataaatccttcagccgtgtygtgccccgagtgccagactccaccagacgaacagatgtgggtgctggtgctttgcgtcgtagtgactctccagaaattcctttccaggctgctgctggcc

SEQ ID NO: 4044 - DNA, 201 bp, Homo sapiens
tagcagtcccacagagcaagaagggagacaagataagccaatggacacgtcagtgttatctgaagaaggaggagagccttttcagaagaaacttcaaagtrgtgaaccagtggagttagaaaacccccctctcctgcctgagtccactgtatcaccacaagcctcaacaccaatatctcagagcacaccagtcttccctcc

SEQ ID NO: 4045 - DNA, 151 bp, Homo sapiens
attccctgctatcgtggagattgtgttttaaccaggttttaaatgtgtcttgtgtgtaactggattccttgcatggatcttgtatatagttttatttgctkaacttttatgataaaataaatgttgaatctctttggttgtagtaactggg

SEQ ID NO: 4046 - DNA, 201 bp, Homo sapiens
gtggcacaggtgcaatcgtggaataccacgggcctgttgtagactccatctcctgcactggcatggtgacagtctgcaacatgggcttagaaattgggacmaccacttccgtgttccattacaacctcaggatgaagaagtacatgagcaagacctgccaggcagacattgccaatctagctgatgaattcaaagatcact

SEQ ID NO: 4047 - DNA, 201 bp, Homo sapiens
tgggaaattcaaagaagatttcatcagtgcatttaactatgatggtactcctgctgtgagacaagaatggcagaatgactcccatgccctgacagttggamgagatcaagctcccaaggcgccgtctgctttcatgggtttggcctgccagggaagagctcagcaaatccagctgaaagaggtgatgaagtcagacctact

SEQ ID NO: 4048 - DNA, 201 bp, Homo sapiens
ctatgacctgctagagaagaacattaacattcctggggggcatctgcattggagttgggggtgccgagctgtggatgtcatgactgggatcccctgggagytgaagtgccccaaggtgattggcgtgaagctgatgggctccctctctggttggacctcacccaaagatgtgatcctgaaggtggcaggcatcctcaccat

SEQ ID NO: 4049 - DNA, 201 bp, Homo sapiens
tccctctctggttggacctcacccaaagatgtgatcctgaaggtggcaggcatcctcaccatgaaaggtggcacaggtgcaatcgtggaataccacgggcytgttgtagactccatctcctgcactggcatggtgacagtctgcaacatgggcttagaaattgggacaaccacttccgtgttccattacaacctcaggatg

SEQ ID NO: 4050 - DNA, 135 bp, Homo sapiens
atggaagctcagaggagggagcccctaaattactstgggaaattcaaagaagatttcatcagtgcatttaactatgatggtactcctgctgtgagacaagaatggcagaatgactcccatgccctgacagttgga

SEQ ID NO: 4051 - DNA, 201 bp, Homo sapiens
agagactgtcacagccctggccattgtgggaaccctcaagttcaacccagagaccaactacctgacaggcaaggatggcaagaagttcaagctggaggctscggatgcagatgagcttccccaagcagagtttggcccagggcaggacacctaccagcacccccgcatgggtggtgccatcaacattgaaaatggcaaggc

SEQ ID NO: 4052 - DNA, 101 bp, Homo sapiens
gcctgctgcccctgaccttcgctgacccagctgacaacaagattcaccttgtggacaagctgaccattcagagcctgaaggacttgacgctggcaagcccy

SEQ ID NO: 4053 - DNA, 201 bp, Homo sapiens
tgggcaagatccgtgcctccattgagcaggatggctatgcacagaccttgagggatgtgggtggcatcgtcctggccaatgcttgtggcccctgcattggycagttgcacagaaaggacatcaacaagcaggagaagaacataattgtcacctcctacaacaggaacttcatgggccacaatgacacgaaccccgagaccc

SEQ ID NO: 4054 - DNA, 201 bp, Homo sapiens; identical to SEQ ID NO: 4046

SEQ ID NO: 4055 - DNA, 201 bp, Homo sapiens
gcactgactcccacacccccaatggtggcagcctggggggcatctgcattggagttgggggtgccgagctgtggatgtcatgactgggatcccctgggagytgaagtgccccaaggtgattggcgtgaagctgatgggctccctctctggttggacctcacccaaagatgtgatcctgaaggtggcaggcatcctcaccat

SEQ ID NO: 4056 - DNA, 201 bp, Homo sapiens
aaccggcctctgaccctctcagagaagatcgtgtacagacacccggatgaccccaccagccaggaaattgagcggggcgggacgtacctgcagcagtggcyggacagcgtgaccatgcaggatggacggcccagatggccatgctgcagttcatcagcagcaggctcccaaggtgaccatgccatccaccatccactgtga

SEQ ID NO: 4057 - DNA, 201 bp, Homo sapiens; identical to SEQ ID NO: 4049

SEQ ID NO: 4058 - DNA, 201 bp, Homo sapiens
accggcctctgaccctctcagagaagatcgtgtacagacacccggatgaccccaccagccaggaaattgagcggggcgggacgtacctgcagcagtggccrgacagcgtgaccatgcaggatggacggcccagatggccatgctgcagttcatcagcagcaggctcccaaggtgaccatgccatccaccatccactgtgac

SEQ ID NO: 4059 - DNA, 201 bp, Homo sapiens
agagactgtcacagccctggccattgtgggaaccctcaagttcaacccagagaccaactacctgacaggcaaggatggcaagaagttcaagctggaggctscggatgcagatgagcttccccaagcagagtttggcccagggcaggacacctaccagcacccccgcatggggtaccactgaccacatctcagctgccggcc

SEQ ID NO: 4060 - DNA, 201 bp, Homo sapiens
gcctgctgcccctgaccttcgctgacccagctgacaacaagattcaccttgtggacaagctgaccattcagagcctgaaggacttgacgctggcaagcccytgaagtacatcgtcaagcaccccaggaaatcaacctcctgaaccacaccttcaacgagacggagatcgagtggttcagggccggcagtgccctctacaga

SEQ ID NO: 4061 - DNA, 201 bp, Homo sapiens
cctggccccaggttctcggctctcaggacgtcccagcaagtggagcccagaggtttgctgggactcccagccaggggatgaggcccagccccagaacctgsagtgcttctttgacggggccgccgtgctcagctgctcctgggaggtgaggaaggaggtggccagctcggtctcctttggcctattctacaagcccagccc

SEQ ID NO: 4062 - DNA, 201 bp, Homo sapiens
gtgggagccagaagtccccacctccagggtccctggagtacctgtgtctgcctgctggggggcaggtgcaactggtccctctggcccaggcgatgggaccrggacaggccgtggaagtggagagaaggccgagccagggggctgcagggagtccctccctggagtccgggggaggccctgcccctcctgctcttgggccaa

SEQ ID NO: 4063 - DNA, 201 bp, Homo sapiens
gaggcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctc

SEQ ID NO: 4064 - DNA, 201 bp, Homo sapiens
ccagccaggcccgcctgccgcctcccacacacctgagaaacaggcttccagctttgacttcaatgggccctacctggggccgccccacagccgctccctamctgacatcctgggccagccggagcccccacaggagggtgggagccagaagtccccacctccagggtccctggagtacctgtgtctgcctgctggggggca

SEQ ID NO: 4065 - DNA, 201 bp, Homo sapiens
tgcagggagtccctccctggagtccgggggaggccctgcccctcctgctcttgggccaagggtgggaggacaggaccaaaaggacagccctgtggctatayccatgagctctggggacactgaggaccctggagtggcctctggttatgtctcctctgcagacctggtattcaccccaaactcaggggcctcgtctgtctc

SEQ ID NO: 4066 - DNA, 201 bp, Homo sapiens
cagatgtgtccccaacatccccacagcccgagggcctccttgtcctgcagcaagtgggcgactattgcttcctccccggcctggggcccggccctctctckctccggagtaaaccttcttccccgggacccggtcctgagatcaagaacctagaccaggcttttcaagtcaagaagcccccaggccaggctgtgccccagg

SEQ ID NO: 4067 - DNA, 201 bp, Homo sapiens
ctggagtgtggcccttgggagtccccagagccactggttgtccccaggggatctggagtttgaggtggtctacaagcggcttcaggactcttgggaggacrcagccatcctcctctccaacacctcccaggccaccctggggccagagcacctcatgcccagcagcacctacgtggcccgagtacggacccgcctggcccc

SEQ ID NO: 4068 - DNA, 201 bp, Homo sapiens
acgcccacagcatggccctgccagccctggagccctccaccaggtactgggccagggtgagggtcaggacctcccgcaccggctacaacgggatctggagygagtggagtgaggcgcgctcctgggacaccgagtcggtgctgcctatgtgggtgctggccctcatcgtgatcttcctcaccatcgctgtgctcctggccc

SEQ ID NO: 4069 - DNA, 201 bp, Homo sapiens
gagggtgggagccagaagtccccacctccagggtccctggagtacctgtgtctgcctgctggggggcaggtgcaactggtccctctggcccaggcgatggkaccgggacaggccgtggaagtggagagaaggccgagccagggggctgcagggagtccctccctggagtccgggggaggccctgcccctcctgctcttggg

SEQ ID NO: 4070 - DNA, 201 bp, Homo sapiens
gaagtccccacctccagggtccctggagtacctgtgtctgcctgctggggggcaggtgcaactggtccctctggcccaggcgatgggaccgggacaggccrtggaagtggagagaaggccgagccagggggctgcagggagtccctccctggagtccgggggaggccctgcccctcctgctcttgggccaagggtgggagg

SEQ ID NO: 4071 - DNA, 201 bp, Homo sapiens
tggagctccctccaattgagggccggtcccccaggtcaccaaggaacaatcctgtcccccctgaggccaaaagccctgtcctgaacccaggggaacgcccrgcagatgtgtccccaacatccccacagcccgagggcctccttgtcctgcagcaagtgggcgactattgcttcctccccggcctggggcccggccctctct

SEQ ID NO: 4072 - DNA, 201 bp, Homo sapiens
ccaggtcaccaaggaacaatcctgtcccccctgaggccaaaagccctgtcctgaacccaggggaacgcccggcagatgtgtccccaacatccccacagccmgagggcctccttgtcctgcagcaagtgggcgactattgcttcctccccggcctggggcccggccctctctcgctccggagtaaaccttcttccccgggac

SEQ ID NO: 4073 - DNA, 201 bp, Homo sapiens
acgtgaccctcattcgccgggtgaatgaggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccg

SEQ ID NO: 4074 - DNA, 201 bp, Homo sapiens
acctcatgcccagcagcacctacgtggcccgagtacggacccgcctggccccaggttctcggctctcaggacgtcccagcaagtggagcccagaggtttgytgggactcccagccaggggatgaggcccagccccagaacctggagtgcttctttgacggggccgccgtgctcagctgctcctgggaggtgaggaaggagg

SEQ ID NO: 4075 - DNA, 201 bp, Homo sapiens
gacaggcaaggggatggagagggcttgccttccctcccgcctgaccttcctcagtcatttctgcaaagccaaggggcagcctcctgtcaaggtagctagargcctgggaaaggagatagccttgctccggcccccttgaccttcagcaaatcacttctctccctgcgctcacacagacacacacacacacacgtacatgca

SEQ ID NO: 4076 - DNA, 201 bp, Homo sapiens
cagacacacacacacacacgtacatgcacacatttttcctgtcaggttaacttatttgtaggttctgcattattagaactttctagatatactcattccawctccccctcatttttttaatcaggtttccttgcttttgccatttttcttccttcttttttcactgatttattatgagagtggggctgaggtctgagctga

SEQ ID NO: 4077 - DNA, 201 bp, Homo sapiens
atcaggtttccttgcttttgccatttttcttccttcttttttcactgatttattatgagagtggggctgaggtctgagctgagccttatcagactgagatkcagctggttgtgttgaggacttgtgtgggctgcctgtccccggcagtcgctgatgcacatgacatgattctcatctgggtgcagaggtgggaggcaccag

SEQ ID NO: 4078 - DNA, 201 bp, Homo sapiens
caggtttccttgcttttgccatttttcttccttcttttttcactgatttattatgagagtggggctgaggtctgagctgagccttatcagactgagatgcrgctggttgtgttgaggacttgtgtgggctgcctgtccccggcagtcgctgatgcacatgacatgattctcatctgggtgcagaggtgggaggcaccaggt

SEQ ID NO: 4079 - DNA, 201 bp, Homo sapiens
gagcttctggggagccctgctagttgtctcagtgatgtctgtgggacctccagtcccttgagaccccacgtcatgtagagaagttaacggcccaagtggtsggcaggctggcgggacctggggaacatcaggagaggagtccagagcccacgtctactgcggaaaagtcaggggaaactgccaaacaaaggaaaatgcccc

SEQ ID NO: 4080 - DNA, 201 bp, Homo sapiens
gagccctgctagttgtctcagtgatgtctgtgggacctccagtcccttgagaccccacgtcatgtagagaagttaacggcccaagtggtgggcaggctggygggacctggggaacatcaggagaggagtccagagcccacgtctactgcggaaaagtcaggggaaactgccaaacaaaggaaaatgccccaaaggcatata

SEQ ID NO: 4081 - DNA, 201 bp, Homo sapiens
ggtattttttaactgggccaagcccattaaggtctttcttctgttgggtgctatcattttctgattaagtctttttgactattgacatacagtctttcacrgatggtggagtgtttttcccccaaatctgttgtttgtcttataatgttgtatatgaggttttatggtgtatgaatatgaatgcttctgtaatgtcaaaca

SEQ ID NO: 4082 - DNA, 201 bp, Homo sapiens; identical to SEQ ID NO: 4061

SEQ ID NO: 4083 - DNA, 201 bp, Homo sapiens; identical to SEQ ID NO: 4062

SEQ ID NO: 4084 - DNA, 201 bp, Homo sapiens; identical to SEQ ID NO: 4063

SEQ ID NO: 4085 - DNA, 201 bp, Homo sapiens; identical to SEQ ID NO: 4064

SEQ ID NO: 4086 - DNA, 201 bp, Homo sapiens; identical to SEQ ID NO: 4065

SEQ ID NO: 4087 - DNA, 201 bp, Homo sapiens; identical to SEQ ID NO: 4066

SEQ ID NO: 4088 - DNA, 201 bp, Homo sapiens; identical to SEQ ID NO: 4067

SEQ ID NO: 4089 - DNA, 201 bp, Homo sapiens; identical to SEQ ID NO: 4068

SEQ ID NO: 4090 - DNA, 201 bp, Homo sapiens; identical to SEQ ID NO: 4069

SEQ ID NO: 4091 - DNA, 201 bp, Homo sapiens; identical to SEQ ID NO: 4070

SEQ ID NO: 4092 - DNA, 201 bp, Homo sapiens; identical to SEQ ID NO: 4071

SEQ ID NO: 4093 - DNA, 201 bp, Homo sapiens; identical to SEQ ID NO: 4072

SEQ ID NO: 4094 - DNA, 201 bp, Homo sapiens; identical to SEQ ID NO: 4073

SEQ ID NO: 4095 - DNA, 201 bp, Homo sapiens; identical to SEQ ID NO: 4074

SEQ ID NO: 4096 - DNA, 201 bp, Homo sapiens; identical to SEQ ID NO: 4075

SEQ ID NO: 4097 - DNA, 201 bp, Homo sapiens; identical to SEQ ID NO: 4076

SEQ ID NO: 4098 - DNA, 201 bp, Homo sapiens; identical to SEQ ID NO: 4077

SEQ ID NO: 4099 - DNA, 201 bp, Homo sapiens; identical to SEQ ID NO: 4078

SEQ ID NO: 4100 - DNA, 201 bp, Homo sapiens; identical to SEQ ID NO: 4079

SEQ ID NO: 4101 - DNA, 201 bp, Homo sapiens; identical to SEQ ID NO: 4080

SEQ ID NO: 4102 - DNA, 201 bp, Homo sapiens; identical to SEQ ID NO: 4081

SEQ ID NO: 4103 - DNA, 201 bp, Homo sapiens; identical to SEQ ID NO: 4061

SEQ ID NO: 4104 - DNA, 201 bp, Homo sapiens; identical to SEQ ID NO: 4062

SEQ ID NO: 4105 - DNA, 198 bp, Homo sapiens
gcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctc

SEQ ID NO: 4106 - DNA, 201 bp, Homo sapiens; identical to SEQ ID NO: 4064

SEQ ID NO: 4107 - DNA, 201 bp, Homo sapiens; identical to SEQ ID NO: 4065

SEQ ID NO: 4108 - DNA, 201 bp, Homo sapiens; identical to SEQ ID NO: 4066

SEQ ID NO: 4109 - DNA, 201 bp, Homo sapiens; identical to SEQ ID NO: 4067

SEQ ID NO: 4110 - DNA, 201 bp, Homo sapiens; identical to SEQ ID NO: 4068

SEQ ID NO: 4111 - DNA, 201 bp, Homo sapiens; identical to SEQ ID NO: 4069

SEQ ID NO: 4112 - DNA, 201 bp, Homo sapiens; identical to SEQ ID NO: 4070

SEQ ID NO: 4113 - DNA, 201 bp, Homo sapiens; identical to SEQ ID NO: 4071

SEQ ID NO: 4114 - DNA, 201 bp, Homo sapiens; identical to SEQ ID NO: 4072

SEQ ID NO: 4115 - DNA, 201 bp, Homo sapiens; identical to SEQ ID NO: 4073

SEQ ID NO: 4116 - DNA, 201 bp, Homo sapiens; identical to SEQ ID NO: 4074

SEQ ID NO: 4117 - DNA, 201 bp, Homo sapiens; identical to SEQ ID NO: 4075

SEQ ID NO: 4118 - DNA, 201 bp, Homo sapiens; identical to SEQ ID NO: 4076

SEQ ID NO: 4119 - DNA, 201 bp, Homo sapiens; identical to SEQ ID NO: 4077

SEQ ID NO: 4120 - DNA, 201 bp, Homo sapiens; identical to SEQ ID NO: 4078

SEQ ID NO: 4121 - DNA, 201 bp, Homo sapiens; identical to SEQ ID NO: 4079

SEQ ID NO: 4122 - DNA, 201 bp, Homo sapiens; identical to SEQ ID NO: 4080

SEQ ID NO: 4123 - DNA, 201 bp, Homo sapiens; identical to SEQ ID NO: 4081

SEQ ID NO: 4124 - DNA, 201 bp, Homo sapiens
cgtaaggagtacctacttcttaaacaaacactgagatccccagaggcgggcccgatcagagaggaaccccgcgtgttcctagaacatggggaacaggcctrtgagagggaccagtcacaaccaagcgcaccactggaggaccagtcctacagagacaggaccactggagagctagaacaggaggatgactcctgtcacagg

SEQ ID NO: 4125 - DNA, 201 bp, Homo sapiens
ccagaaaactagaccacaaagagcctgactgccgaacagtcaggacacaagagttgggcctctcagaggaccacatcatctgggatggtaccttggggggkccagagcatagtgtcctcgatctctggaggactaaaccacccaaaggccaggcccccactgatagaagctccagagatggaacctccaatgagcctagtc

SEQ ID NO: 4126 - DNA, 201 bp, Homo sapiens
tggctgcaacaggccatcaatagccgtaaggagtacctacttcttaaacaaacactgagatccccagaggcgggcccgatcagagaggaaccccgcgtgtkcctagaacatggggaacaggcctgtgagagggaccagtcacaaccaagcgcaccactggaggaccagtcctacagagacaggaccactggagagctagaa

SEQ ID NO: 4127 - DNA, 201 bp, Homo sapiens
cagaggaccacatcatctgggatggtaccttgggggggccagagcatagtgtcctcgatctctggaggactaaaccacccaaaggccaggcccccactgayagaagctccagagatggaacctccaatgagcctagtcatgaaggacagaaaaagcagaggactataccatggagatcaaagtcacctgagattctgtctt

SEQ ID NO: 4128 - DNA, 201 bp, Homo sapiens
gatcagagaggaaccccgcgtgttcctagaacatggggaacaggcctgtgagagggaccagtcacaaccaagcgcaccactggaggaccagtcctacagasacaggaccactggagagctagaacaggaggatgactcctgtcacagggtcaaatcaccccacagatccccaggaagtttggccactacacaaaaaaacat

SEQ ID NO: 4129 - DNA, 201 bp, Homo sapiens
taagtgcagagaaccatgctacagcaagtctggaccaccgtcgtctataccatcaaacagccaggccttgggggacaggctcaccaaagggccagacgatrgaagacagacctttggagggacctgcctgctgcagatgaaaatcctggaggaccagacccccagaggtttaaaacctaggaaccattgtcccaggaagtc

SEQ ID NO: 4130 - DNA, 201 bp, Homo sapiens
aaagtcacctgagattctgtcttctacaaaggcaggctgtacaggagaggaacagtggaggggcaggccatggaaaacagaaccacctggctagaccctakgaagccaggagaggatcaggttccaaaggggaatgctatgaaagggcagtgagacaagacctcatcctacctccctgaccagctctggcttctgctcctg

SEQ ID NO: 4131 - DNA, 201 bp, Homo sapiens
tactgtttcctgatccaacagcttacctgatccaagggctcctctgtctgagtgtcttcatcatctgctacttccagggcccccgctgtctccttccttckgtggggagctccatatactcctataactcctaaagaggggaggcagcactgggtgatgcccaggctgaagagccctcagcattcctgccctggaccttca

SEQ ID NO: 4132 - DNA, 201 bp, Homo sapiens
actgtttcctgatccaacagcttacctgatccaagggctcctctgtctgagtgtcttcatcatctgctacttccagggcccccgctgtctccttccttcgktggggagctccatatactcctataactcctaaagaggggaggcagcactgggtgatgcccaggctgaagagccctcagcattcctgccctggaccttcat

SEQ ID NO: 4133 - DNA, 201 bp, Homo sapiens
taagacccaggggcaacagtctaccctttgagtgggccgaacccacttccagctctgctgcctccaggaagcccctgggccatgaagtgctggcagtgagyggatggacctagcacttcccctctctggccttagcttcctcctctcttatggggataacagctacctcatggatcacaataagagaacaagagtgaaaga

SEQ ID NO: 4134 - DNA, 201 bp, Homo sapiens
tcaagcaggcagcaggctcaggccacctccttgctcttgggacaccagagaacccatcttggctcagtctccacctccaagatcaaaaggtggtgttgtcytctgggtcggggccagggctggatctgcccctggtcttgggactccctcttcagctgaagctgagtatgtccagggtggtcttgagccaagggtcgaaga

SEQ ID NO: 4135 - DNA, 201 bp, Homo sapiens
tccaagatcaaaaggtggtgttgtcttctgggtcggggccagggctggatctgcccctggtcttgggactccctcttcagctgaagctgagtatgtccagrgtggtcttgagccaagggtcgaagatgaaggcccttgccctgcctcccttaggcctggctcccctccttaacctctgggccaagcctcaagggcgtctct

SEQ ID NO: 4136 - DNA, 201 bp, Homo sapiens
cgcctgagacaggtctctgggcccctgaccagcaaacgccatcccatcatgaggattgcgcttggggggctgctcttccccgcttccaaccttcggttgcygctggttcctgccctggatggctgcctgcgccgggattcctggctggacaaacaggccgagatctcagcatctgcccccactagcctcagaagctgtgat

SEQ ID NO: 4137 - DNA, 175 bp, Homo sapiens
tatggagagcagaggcccactggctacctcgcgcctgctgctgttgctgctgttgctactactgcgtcacacccrccagggatgggccctgagacctgttctccccacccagagtgcccacgaccctccggctgtccacctcagcaatggcccaggacaagagcctatcgctgtc

SEQ ID NO: 4138 - DNA, 201 bp, Homo sapiens
tggctacctcgcgcctgctgctgttgctgctgttgctactactgcgtcacacccgccagggatgggccctgagacctgttctccccacccagagtgcccaygaccctccggctgtccacctcagcaatggcccaggacaagagcctatcgctgtcatgacctttgacctcaccaagatcacaaaaacctcctcctcctttg

SEQ ID NO: 4139 - DNA, 201 bp, Homo sapiens
gatgaaggcccttgccctgcctcccttaggcctggctcccctccttaacctctgggccaagcctcaagggcgtctcttcctgggggctttaccaggagaaractcttccacctctttttgcctgaatggcctttgggcacaaggtcagaggctggatgtggaccaggccctgaacagaagccatgagatctggactcacag

SEQ ID NO: 4140 - DNA, 166 bp, Homo sapiens
tatggagagcagaggcccactggctacctcgcgcctgctgctgttgctgctgttgctactactgcrtcacacccgccagggatgggccctgagacctgttctccccacccagagtgcccacgaccctccggctgtccacctcagcaatggcccaggacaagagcct

SEQ ID NO: 4141 - DNA, 101 bp, Homo sapiens
gccctgaacagaagccatgagatctggactcacagctgcccccagagcccaggcaatggcactgacgcttcccattaaagctccacctaagaacccccttt

SEQ ID NO: 4142 - DNA, 201 bp, Homo sapiens; identical to SEQ ID NO: 4134

SEQ ID NO: 4143 - DNA, 201 bp, Homo sapiens; identical to SEQ ID NO: 4135

SEQ ID NO: 4144 - DNA, 201 bp, Homo sapiens; identical to SEQ ID NO: 4136

SEQ ID NO: 4145 - DNA, 201 bp, Homo sapiens
ggttcaaaggctcccccgcagtgctttttaaattgacatatgcagtgataacctgctttagcctcaggctcactcacccgcccagaccctggagtgcccaygaccctccggctgtccacctcagcaatggcccaggacaagagcctatcgctgtcatgacctttgacctcaccaagatcacaaaaacctcctcctcctttg

SEQ ID NO: 4146 - DNA, 201 bp, Homo sapiens; identical to SEQ ID NO: 4139

SEQ ID NO: 4147 - DNA, 101 bp, Homo sapiens; identical to SEQ ID NO: 4141

SEQ ID NO: 4148 - DNA, 201 bp, Homo sapiens; identical to SEQ ID NO: 4134

SEQ ID NO: 4149 - DNA, 201 bp, Homo sapiens; identical to SEQ ID NO: 4135

SEQ ID NO: 4150 - DNA, 201 bp, Homo sapiens; identical to SEQ ID NO: 4136

SEQ ID NO: 4151 - DNA, 201 bp, Homo sapiens
ggctcactcacccgcccagaccctggtatggagagcagaggcccactggctacctcgcgcctgctgctgttgctgctgttgctactactgcgtcacacccrccagggatgggccctgagacctgttctccccacccagagtgcccacgaccctccggctgtccacctcagcaatggcccaggacaagagcctatcgctgtc

SEQ ID NO: 4152 - DNA, 201 bp, Homo sapiens; identical to SEQ ID NO: 4138

SEQ ID NO: 4153 - DNA, 201 bp, Homo sapiens; identical to SEQ ID NO: 4139

SEQ ID NO: 4154 - DNA, 201 bp, Homo sapiens
ttagcctcaggctcactcacccgcccagaccctggtatggagagcagaggcccactggctacctcgcgcctgctgctgttgctgctgttgctactactgcrtcacacccgccagggatgggccctgagacctgttctccccacccagagtgcccacgaccctccggctgtccacctcagcaatggcccaggacaagagcct

SEQ ID NO: 4155 - DNA, 101 bp, Homo sapiens; identical to SEQ ID NO: 4141

SEQ ID NO: 4156 - DNA, 201 bp, Homo sapiens
tgattcgggagctagccgaattcgaaaaactctcggatcaggtgaagatcagtgaagaagccctgagagcagatggctttggagacaatcctttctatcaytgtttggtagcagagattcttccagcgcccgggaagctactggggccctgcgtggtgggctatgggatatactatttcatctacagtacatggaagggac

SEQ ID NO: 4157 - DNA, 201 bp, Homo sapiens
ggatatctatgtgatgccggaatatcggggtcaagggattggttccaaaataatcaaaaaggtggctgaggtggccttggataagggctgctcccaattcygcctggccgtcctggactggaaccagagggccatggacttgtacaaggccctaggagcccaagatctgacggaagctgagggctggcacttcttctgctt

SEQ ID NO: 4158 - DNA, 201 bp, Homo sapiens
agctactggggccctgcgtggtgggctatgggatatactatttcatctacagtacatggaagggacgcaccatttatctggaggatatctatgtgatgccrgaatatcggggtcaagggattggttccaaaataatcaaaaaggtggctgaggtggccttggataagggctgctcccaattccgcctggccgtcctggact

SEQ ID NO: 4159 - DNA, 201 bp, Homo sapiens
ggctctgtccaggcgcccagctacggcgcccggccggtcagcagcgcggccagcgtctatgcaggcgctgggggctctggttcccggatctccgtgtccckctccaccagcttcaggggcggcatggggtccgggggcctggccaccgggatagccgggggtctggcaggaatgggaggcatccagaacgagaaggagacc

SEQ ID NO: 4160 - DNA, 201 bp, Homo sapiens
ccaggcccaggagtatgaggccctgctgaacatcaaggtcaagctggaggctgagatcgccacctaccgccgcctgctggaagatggcgaggactttaatyttggtgatgccttggacagcagcaactccatgcaaaccatccaaaagaccaccacccgccggatagtggatggcaaagtggtgtctgagaccaatgacac

SEQ ID NO: 4161 - DNA, 201 bp, Homo sapiens
tggagaacagcctgagggaggtggaggcccgctacgccctacagatggagcagctcaacgggatcctgctgcaccttgagtcagagctggcacagacccgrgcagagggacagcgccaggcccaggagtatgaggccctgctgaacatcaaggtcaagctggaggctgagatcgccacctaccgccgcctgctggaagatg

SEQ ID NO: 4162 - DNA, 201 bp, Homo sapiens
atgagacagagctggccatgcgccagtctgtggagaacgacatccatgggctccgcaaggtcattgatgacaccaatatcacacgactgcagctggagacmgagatcgaggctctcaaggaggagctgctcttcatgaagaagaaccacgaagaggaagtaaaaggcctacaagcccagattgccagctctgggttgaccg

SEQ ID NO: 4163 - DNA, 201 bp, Homo sapiens
gatcgccacctaccgccgcctgctggaagatggcgaggactttaatcttggtgatgccttggacagcagcaactccatgcaaaccatccaaaagaccaccmcccgccggatagtggatggcaaagtggtgtctgagaccaatgacaccaaagttctgaggcattaagccagcagaagcagggtaccctttggggagcagga

SEQ ID NO: 4164 - DNA, 201 bp, Homo sapiens
gtacagtccagtccttggagatcgacctggactccatgagaaatctgaaggccagcttggagaacagcctgagggaggtggaggcccgctacgccctacasatggagcagctcaacgggatcctgctgcaccttgagtcagagctggcacagacccgggcagagggacagcgccaggcccaggagtatgaggccctgctga

SEQ ID NO: 4165 - DNA, 201 bp, Homo sapiens
ttgctgctgatgactttagagtcaagtatgagacagagctggccatgcgccagtctgtggagaacgacatccatgggctccgcaaggtcattgatgacacyaatatcacacgactgcagctggagacagagatcgaggctctcaaggaggagctgctcttcatgaagaagaaccacgaagaggaagtaaaaggcctacaag

SEQ ID NO: 4166 - DNA, 201 bp, Homo sapiens
gggcgggggcggggcctcactctgcgatataactcgggtcgcgcggctcgcgcaggccgccaccgtcgtccgcaaagcctgagtcctgtcctttctctctycccggacagcatgagcttcaccactcgctccaccttctccaccaactaccggtccctgggctctgtccaggcgcccagctacggcgcccggccggtcagc

SEQ ID NO: 4167 - DNA, 201 bp, Homo sapiens
ctatgcaggcgctgggggctctggttcccggatctccgtgtcccgctccaccagcttcaggggcggcatggggtccgggggcctggccaccgggatagccrggggtctggcaggaatgggaggcatccagaacgagaaggagaccatgcaaagcctgaacgaccgcctggcctcttacctggacagagtgaggagcctgga

SEQ ID NO: 4168 - DNA, 201 bp, Homo sapiens
cgggatcctgctgcaccttgagtcagagctggcacagacccgggcagagggacagcgccaggcccaggagtatgaggccctgctgaacatcaaggtcaagstggaggctgagatcgccacctaccgccgcctgctggaagatggcgaggactttaatcttggtgatgccttggacagcagcaactccatgcaaaccatcca

SEQ ID NO: 4169 - DNA, 201 bp, Homo sapiens
tgctgctgatgactttagagtcaagtatgagacagagctggccatgcgccagtctgtggagaacgacatccatgggctccgcaaggtcattgatgacaccratatcacacgactgcagctggagacagagatcgaggctctcaaggaggagctgctcttcatgaagaagaaccacgaagaggaagtaaaaggcctacaagc

SEQ ID NO: 4170 - DNA, 162 bp, Homo sapiens
atgcagaagtcctcttctactcgggctggggatatgcgtgagaaagacacgcgtggatgccrtatgagctctcgttctgaatgcggaaatctgacctcccaccggatactcagttcagggggctcctggaccctccagctgctcctctactcatcgctccct

SEQ ID NO: 4171 - DNA, 109 bp, Homo sapiens
cctctactcatcgctccctcactcagaaaaccagcagagaagtgaacttcctcaaatgactgacggtaaatatccagcatggagctggattacaaaactgyataaactg

SEQ ID NO: 4172 - DNA, 138 bp, Homo sapiens
atgcagaagtcctcttctactcgggctggggatatgcrtgagaaagacacgcgtggatgccgtatgagctctcgttctgaatgcggaaatctgacctcccaccggatactcagttcagggggctcctggaccctccag

SEQ ID NO: 4173 - DNA, 201 bp, Homo sapiens
tagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccga

SEQ ID NO: 4174 - DNA, 201 bp, Homo sapiens
gggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtctttcctactcaaaatggtttttatggattctattcttatttgg

SEQ ID NO: 4175 - DNA, 201 bp, Homo sapiens
cttaggggttagaaggggatcaaggaaagtccgagagttggttgtgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagcc

SEQ ID NO: 4176 - DNA, 201 bp, Homo sapiens
accacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggt

SEQ ID NO: 4177 - DNA, 155 bp, Homo sapiens
atgaccagttatacttcatcaactctaacaaatgaaggagcagagttggttttcyggagtttgcttcagttctttgatatgaggcaagaggtactcgatgaaccacatgctaaaataaaaaaaaatgaaccacatgctaaaatcaaatggcttct

SEQ ID NO: 4178 - DNA, 201 bp, Homo sapiens
cttcatacctcaaactgcatgatgtcctgaaagctacacacgctaactacaaggtcacgctggatcttcagaacagcacggaaaagtttggagggtttctycgctcagccttggatgttctttctcagatactagagctggccacactgcaggacattgggaagtgtgttgaagagatcctaggatacctgaaatcctgct

SEQ ID NO: 4179 - DNA, 201 bp, Homo sapiens
cagctctgtgatggcatcatggccagtggaaggaaggctgtgacacatgccataccggctctgcagcccatagtccacgacctctttgtattaagaggaayaaataaagctgatgcaggaaaagagcttgaaacccaaaaagaggtggtggtgtcaatgttactgagactcatccagtaccatcaggtgttggagatgttc

SEQ ID NO: 4180 - DNA, 201 bp, Homo sapiens
cacccaaaccgggaggggattttggcacagcattccctgagatccccgtggagttcctccaggaaaaggaagtctttaaggagttcatctaccgcatcaayacactaggctggaccagtcgtactcagtttgaagaaacttgggccaccctccttggtgtcctggtgacgcagcccctcgtgatggagcaggaggagagcc

SEQ ID NO: 4181 - DNA, 201 bp, Homo sapiens
cctcaagtccttccagcagcagcagcagcagcagcagcagcagcagcagcagcagcagcagcagcagcacacagccgccaccgccgccgccgccgccgcckcctcctcagcttcctcagccgccgccgcaggcacagccgctgctgcctcagccgcagccgcccccgccgccgcccccgccgccacccggcccggctgtgg

SEQ ID NO: 4182 - DNA, 201 bp, Homo sapiens
aggtcaaggacacaagcctgaaaggcagcttcggagtgacaaggaaagaaatggaagtctctccttctgcagagcagcttgtccaggtttatgaactgacsttacatcatacacagcaccaagaccacaatgttgtgaccggagccctggagctgttgcagcagctcttcagaacgcctccacccgagcttctgcaaaccc

SEQ ID NO: 4183 - DNA, 201 bp, Homo sapiens
tcttctttccactgccttcccagtttgcatttggagtttaggttggcactgtggagtgcctccactgagtgcctcagatgagtctaggaagagctgtaccrttgggatggccacaatgattctgaccctgctctcgtcagcttggttcccattggatctctcagcccatcaagatgctttgattttggccggaaacttgct

SEQ ID NO: 4184 - DNA, 201 bp, Homo sapiens
taggctgttccgcagtgatggctgtggcggcagtttctacaccctggacagcttgaacttgcgggctcgttccatgatcaccacccacccggccctggtgytgctctggtgtcagatactgctgcttgtcaaccacaccgactaccgctggtgggcagaagtgcagcagaccccgaaaagacacagtctgtccagcacaaa

SEQ ID NO: 4185 - DNA, 201 bp, Homo sapiens
cctgtgagatggtggcagaaatggtggagtctctgcagtcggtgttggccttgggtcataaaaggaatagcggcgtgccggcgtttctcacgccattgctmaggaacatcatcatcagcctggcccgcctgccccttgtcaacagctacacacgtgtgcccccactggtgtggaagcttggatggtcacccaaaccgggag

SEQ ID NO: 4186 - DNA, 201 bp, Homo sapiens
cgcaggctagggctgtcaatcatgctggccggcgtggccccgcctccgccggcgcggccccgcctccgccggcgcagcgtctgggacgcaaggcgccgtgrgggctgccgggacgggtccaagatggacggccgctcaggttctgcttttacctgcggcccagagccccattcattgccccggtgctgagcggcgccgcga

SEQ ID NO: 4187 - DNA, 201 bp, Homo sapiens
cctggaaaagctgatgaaggccttcgagtccctcaagtccttccagcagcagcagcagcagcagcagcagcagcagcagcagcagcagcagcagcagcacrcagccgccaccgccgccgccgccgccgccgcctcctcagcttcctcagccgccgccgcaggcacagccgctgctgcctcagccgcagccgcccccgccgc

SEQ ID NO: 4188 - DNA, 201 bp, Homo sapiens
gcagctcttctctcacctgctgaaggtgattaacatttgtgcccacgtcctggatgacgtggctcctggacccgcaataaaggcagccttgccttctctarcaaaccccccttctctaagtcccatccgacgaaaggggaaggagaaagaaccaggagaacaagcatctgtaccgttgagtcccaagaaaggcagtgaggc

SEQ ID NO: 4189 - DNA, 201 bp, Homo sapiens
tggtcgccacagacttctacagacaccagatagaggaggagctcgaccgcagggccttccagtctgtgcttgaggtggttgcagccccaggaagcccataycaccggctgctgacttgtttacgaaatgtccacaaggtcaccacctgctgagcgccatggtgggagagactgtgaggcggcagctggggccggagccttt

SEQ ID NO: 4190 - DNA, 201 bp, Homo sapiens
atcatacacagcaccaagaccacaatgttgtgaccggagccctggagctgttgcagcagctcttcagaacgcctccacccgagcttctgcaaaccctgacygcagtcgggggcattgggcagctcaccgctgctaaggaggagtctggtggccgaagccgtagtgggagtattgtggaacttataggcaagttattagcaa

SEQ ID NO: 4191 - DNA, 201 bp, Homo sapiens
ccagcagcagcagcagcagcagcagcagcagcagcagcagcagcagcagcagcagcacacagccgccaccgccgccgccgccgccgccgcctcctcagctkcctcagccgccgccgcaggcacagccgctgctgcctcagccgcagccgcccccgccgccgcccccgccgccacccggcccggctgtggctgaggagccgc

SEQ ID NO: 4192 - DNA, 201 bp, Homo sapiens
acacagccgccaccgccgccgccgccgccgccgcctcctcagcttcctcagccgccgccgcaggcacagccgctgctgcctcagccgcagccgcccccgcmgccgcccccgccgccacccggcccggctgtggctgaggagccgctgcaccgaccaaagaaagaactttcagctaccaagaaagaccgtgtgaatcattgt

SEQ ID NO: 4193 - DNA, 201 bp, Homo sapiens
ctggggagtttctatcatcttccttcatacctcaaactgcatgatgtcctgaaagctacacacgctaactacaaggtcacgctggatcttcagaacagcayggaaaagtttggagggtttctccgctcagccttggatgttctttctcagatactagagctggccacactgcaggacattgggaagtgtgttgaagagatc

SEQ ID NO: 4194 - DNA, 201 bp, Homo sapiens
gccaggcttgtaccactactgcttcatggccccgtacacccacttcacccaggccctcgctgacgccagcctgaggaacatggtgcaggcggagcaggagmacgacacctcgggatggtttgatgtcctccagaaagtgtctacccagttgaagacaaacctcacgagtgtcacaaagaaccgtgcagataagaatgctat

SEQ ID NO: 4195 - DNA, 201 bp, Homo sapiens
agaatattgccacccatcatttatatcaggcatgggatcctgtcccttctctgtctccggctactacaggtgccctcatcagccacgagaagctgctgctrcagatcaaccccgagcgggagctggggagcatgagctacaaactcggccaggtgtccatacactccgtgtggctggggaacagcatcacacccctgaggg

SEQ ID NO: 4196 - DNA, 201 bp, Homo sapiens
agctgatgtatgtgacgctgacagaactgcgaagggtgcacccttcagaagacgagatcctcgctcagtacctggtgcctgccacctgcaaggcagctgcygtccttgggatggacaaggccgtggcggagcctgtcagccgcctgctggagagcacgctcaggagcagccacctgcccagcagggttggagccctgcacg

SEQ ID NO: 4197 - DNA, 201 bp, Homo sapiens
gctcccccaccattcggcggacagcggctggatcagcagtgagcatctgccagcactcaagaaggacacaatatttctatagttggctactaaatgtgctsttaggcttactcgttcctgtcgaggatgaacactccactctgctgattcttggcgtgctgctcaccctgaggtatttggtgcccttgctgcagcagcagg

SEQ ID NO: 4198 - DNA, 201 bp, Homo sapiens
ctgcttcttcaggggtttccactccagggtcagcaggtcatgacatcatcacagaacagccacggtcacagcacacactgcaggcggactcagtggatctrgccagctgtgacttgacaagctctgccactgatggggatgaggaggatatcttgagccacagctccagccaggtcagcgccgtcccatctgaccctgcca

SEQ ID NO: 4199 - DNA, 201 bp, Homo sapiens
tttttgaagcagcccgtgaggtgactctggcccgtgtgagcggcaccgtgcagcagctccctgctgtccatcatgtcttccagcccgagctgcctgcagarccggcggcctactggagcaagttgaatgatctgtttggggatgctgcactgtatcagtccctgcccactctggcccgggccctggcacagtacctggtgg

SEQ ID NO: 4200 - DNA, 201 bp, Homo sapiens
agcctggagagcagcttcttagtccagaaagaaggacaaataccccaaaagccatcagcgaggaggaggaggaagtagatccaaacacacagaatcctaartatatcactgcagcctgtgagatggtggcagaaatggtggagtctctgcagtcggtgttggccttgggtcataaaaggaatagcggcgtgccggcgtttc

SEQ ID NO: 4201 - DNA, 201 bp, Homo sapiens
agtctttaaggagttcatctaccgcatcaacacactaggctggaccagtcgtactcagtttgaagaaacttgggccaccctccttggtgtcctggtgacgyagcccctcgtgatggagcaggaggagagcccaccagaagaagacacagagaggacccagatcaacgtcctggccgtgcaggccatcacctcactggtgct

SEQ ID NO: 4202 - DNA, 201 bp, Homo sapiens
ccttgccgcatcaaaggtgacattggacagtccactgatgatgactctgcacctcttgtccattgtgtccgccttttatctgcttcgtttttgctaacagrgggaaaaaatgtgctggttccggacagggatgtgagggtcagcgtgaaggccctggccctcagctgtgtgggagcagctgtggccctccacccggaatct

SEQ ID NO: 4203 - DNA, 201 bp, Homo sapiens
aagaggaggaggaggccgacgcccctgcaccttcgtcaccacccacgtctccagtcaactccaggaaacaccgggctggagttgacatccactcctgttcrcagtttttgcttgagttgtacagccgctggatcctgccgtccagctcagccaggaggaccccggccatcctgatcagtgaggtggtcagatcccttctag

SEQ ID NO: 4204 - DNA, 201 bp, Homo sapiens
cgaccctggaaaagctgatgaaggccttcgagtccctcaagtccttccagcagcagcagcagcagcagcagcagcagcagcagcagcagcagcagcagcarcacacagccgccaccgccgccgccgccgccgccgcctcctcagcttcctcagccgccgccgcaggcacagccgctgctgcctcagccgcagccgcccccg

SEQ ID NO: 4205 - DNA, 201 bp, Homo sapiens
gatctctcagcccatcaagatgctttgattttggccggaaacttgcttgcagccagtgctcccaaatctctgagaagttcatgggcctctgaagaagaagscaacccagcagccaccaagcaagaggaggtctggccagccctgggggaccgggccctggtgcccatggtggagcagctcttctctcacctgctgaaggtg

SEQ ID NO: 4206 - DNA, 201 bp, Homo sapiens
ccggtagacatgcttttacggagtatgttcgtcactccaaacacaatggcgtccgtgagcactgttcaactgtggatatcgggaattctggccattttgarggttctgatttcccagtcaactgaagatattgttctttctcgtattcaggagctctccttctctccgtatttaatctcctgtacagtaattaataggtta

SEQ ID NO: 4207 - DNA, 201 bp, Homo sapiens
tcaactgaagatattgttctttctcgtattcaggagctctccttctctccgtatttaatctcctgtacagtaattaataggttaagagatggggacagtamttcaacgctagaagaacacagtgaagggaaacaaataaagaatttgccagaagaaacattttcaaggtttctattacaactggttggtattcttttagaa

SEQ ID NO: 4208 - DNA, 201 bp, Homo sapiens
ccttgggatggacaaggccgtggcggagcctgtcagccgcctgctggagagcacgctcaggagcagccacctgcccagcagggttggagccctgcacggcrtcctctatgtgctggagtgcgacctgctggacgacactgccaagcagctcatcccggtcatcagcgactatctcctctccaacctgaaagggatcgccca

SEQ ID NO: 4209 - DNA, 201 bp, Homo sapiens
gtagaacttcagaccctaatcctgcagcccccgacagcgagtcagtgattgttgctatggagcgggtatctgttctttttgataggatcaggaaaggcttwccttgtgaagccagagtggtggccaggatcctgccccagtttctagacgacttcttcccaccccaggacatcatgaacaaagtcatcggagagtttctgt

SEQ ID NO: 4210 - DNA, 201 bp, Homo sapiens
aataggttaagagatggggacagtacttcaacgctagaagaacacagtgaagggaaacaaataaagaatttgccagaagaaacattttcaaggtttctatwacaactggttggtattcttttagaagacattgttacaaaacagctgaaggtggaaatgagtgagcagcaacatactttctattgccaggaactaggcaca

SEQ ID NO: 4211 - DNA, 201 bp, Homo sapiens
ctaggaagagctgtaccgttgggatggccacaatgattctgaccctgctctcgtcagcttggttcccattggatctctcagcccatcaagatgctttgatkttggccggaaacttgcttgcagccagtgctcccaaatctctgagaagttcatgggcctctgaagaagaagccaacccagcagccaccaagcaagaggagg

SEQ ID NO: 4212 - DNA, 201 bp, Homo sapiens
gacgcagcccctcgtgatggagcaggaggagagcccaccagaagaagacacagagaggacccagatcaacgtcctggccgtgcaggccatcacctcactgstgctcagtgcaatgactgtgcctgtggccggcaacccagctgtaagctgcttggagcagcagccccggaacaagcctctgaaagctctcgacaccaggtt

SEQ ID NO: 4213 - DNA, 130 bp, Homo sapiens
ttgctgtgtgaggcagaacctgcgggggcrggggcgggctggttccctggccagccattggcagagtccgcaggctagggctgtcaatcatgctggccggcgtggccccgcctccgccggcgcggccccg

SEQ ID NO: 4214 - DNA, 201 bp, Homo sapiens
ctgcgggggcaggggcgggctggttccctggccagccattggcagagtccgcaggctagggctgtcaatcatgctggccggcgtggccccgcctccgccgycgcggccccgcctccgccggcgcagcgtctgggacgcaaggcgccgtgggggctgccgggacgggtccaagatggacggccgctcaggttctgcttttac

SEQ ID NO: 4215 - DNA, 201 bp, Homo sapiens
tcagtccaggagaccttggctgcagctgttcccaaaattatggcttcttttggcaattttgcaaatgacaatgaaattaaggttttgttaaaggccttcayagcgaacctgaagtcaagctcccccaccattcggcggacagcggctggatcagcagtgagcatctgccagcactcaagaaggacacaatatttctatagt

SEQ ID NO: 4216 - DNA, 201 bp, Homo sapiens
ttcctattggctggtgaggacagagcttctggaaacccttgcagagattgacttcaggctggtgagctttttggaggcaaaagcagaaaacttacacagargggctcatcattatacagggcttttaaaactgcaagaacgagtgctcaataatgttgtcatccatttgcttggagatgaagaccccagggtgcgacatgt

SEQ ID NO: 4217 - DNA, 201 bp, Homo sapiens
ctggtgcccatggtggagcagctcttctctcacctgctgaaggtgattaacatttgtgcccacgtcctggatgacgtggctcctggacccgcaataaaggmagccttgccttctctaacaaaccccccttctctaagtcccatccgacgaaaggggaaggagaaagaaccaggagaacaagcatctgtaccgttgagtccc

SEQ ID NO: 4218 - DNA, 201 bp, Homo sapiens
ccaggcagggctggactgctgctgcctggccctgcagctgcctggcctctggagcgtggtctcctccacagagtttgtgacccacgcctgctccctcatcyactgtgtgcacttcatcctggaggccgttgcagtgcagcctggagagcagcttcttagtccagaaagaaggacaaataccccaaaagccatcagcgagga

SEQ ID NO: 4219 - DNA, 201 bp, Homo sapiens
ccagctcagccaggaggaccccggccatcctgatcagtgaggtggtcagatcccttctagtggtctcagacttgttcaccgagcgcaaccagtttgagctratgtatgtgacgctgacagaactgcgaagggtgcacccttcagaagacgagatcctcgctcagtacctggtgcctgccacctgcaaggcagctgccgtcc

SEQ ID NO: 4220 - DNA, 201 bp, Homo sapiens
cccgcaccgggccatggcggctctgggcctgatgctcacctgcatgtacacaggaaaggagaaagtcagtccgggtagaacttcagaccctaatcctgcakcccccgacagcgagtcagtgattgttgctatggagcgggtatctgttctttttgataggatcaggaaaggctttccttgtgaagccagagtggtggccag

SEQ ID NO: 4221 - DNA, 201 bp, Homo sapiens
ccacccgctggacggggatgggcacgtgtcactggaaacagtgagtccggacaaagactggtacgttcatcttgtcaaatcccagtgttggaccaggtcamattctgcactgctggaaggtgcagagctggtgaatcggattcctgctgaagatatgaatgccttcatgatgaactcggagttcaacctaagcctgctagc

SEQ ID NO: 4222 - DNA, 201 bp, Homo sapiens
agtgcctccactgagtgcctcagatgagtctaggaagagctgtaccgttgggatggccacaatgattctgaccctgctctcgtcagcttggttcccattgvatctctcagcccatcaagatgctttgattttggccggaaacttgcttgcagccagtgctcccaaatctctgagaagttcatgggcctctgaagaagaagc

SEQ ID NO: 4223 - DNA, 201 bp, Homo sapiens
cctgttcgcagtttttgcttgagttgtacagccgctggatcctgccgtccagctcagccaggaggaccccggccatcctgatcagtgaggtggtcagatcwcttctagtggtctcagacttgttcaccgagcgcaaccagtttgagctgatgtatgtgacgctgacagaactgcgaagggtgcacccttcagaagacgaga

SEQ ID NO: 4224 - DNA, 201 bp, Homo sapiens
ctgacttgtttacgaaatgtccacaaggtcaccacctgctgagcgccatggtgggagagactgtgaggcggcagctggggccggagcctttggaagtctgygcccttgtgccctgcctccaccgagccagcttggtccctatgggcttccgcacatgccgcgggcggccaggcaacgtgcgtgtctctgccatgtggcaga

SEQ ID NO: 4225 - DNA, 201 bp, Homo sapiens
gagcctgaggccttccagaaagcaggagcagctgtgctgcaccccatgtgggtgaccaggtcctttctcctgatagtcacctgctggttgttgccaggttrcagctgctcttgcatctgggccagaagtcctccctcctgcaggctggctgttggcccctctgctgtcctgcagtagaaggtgccgtgagcaggctttggg

SEQ ID NO: 4226 - DNA, 201 bp, Homo sapiens
tgggtgaccaggtcctttctcctgatagtcacctgctggttgttgccaggttgcagctgctcttgcatctgggccagaagtcctccctcctgcaggctggstgttggcccctctgctgtcctgcagtagaaggtgccgtgagcaggctttgggaacactggcctgggtctccctggtggggtgtgcatgccacgccccgtg

SEQ ID NO: 4227 - DNA, 201 bp, Homo sapiens
tcctttctcctgatagtcacctgctggttgttgccaggttgcagctgctcttgcatctgggccagaagtcctccctcctgcaggctggctgttggcccctstgctgtcctgcagtagaaggtgccgtgagcaggctttgggaacactggcctgggtctccctggtggggtgtgcatgccacgccccgtgtctggatgcaca

SEQ ID NO: 4228 - DNA, 201 bp, Homo sapiens
agaagtcctccctcctgcaggctggctgttggcccctctgctgtcctgcagtagaaggtgccgtgagcaggctttgggaacactggcctgggtctccctgrtggggtgtgcatgccacgccccgtgtctggatgcacagatgccatggcctgtgctgggccagtggctgggggtgctagacacccggcaccattctccctt

SEQ ID NO: 4229 - DNA, 201 bp, Homo sapiens
caggctggctgttggcccctctgctgtcctgcagtagaaggtgccgtgagcaggctttgggaacactggcctgggtctccctggtggggtgtgcatgccaygccccgtgtctggatgcacagatgccatggcctgtgctgggccagtggctgggggtgctagacacccggcaccattctcccttctctcttttcttctcag

SEQ ID NO: 4230 - DNA, 201 bp, Homo sapiens
agtagaaggtgccgtgagcaggctttgggaacactggcctgggtctccctggtggggtgtgcatgccacgccccgtgtctggatgcacagatgccatggcmtgtgctgggccagtggctgggggtgctagacacccggcaccattctcccttctctcttttcttctcaggatttaaaatttaattatatcagtaaagagat

SEQ ID NO: 4231 - DNA, 201 bp, Homo sapiens
tttgggaacactggcctgggtctccctggtggggtgtgcatgccacgccccgtgtctggatgcacagatgccatggcctgtgctgggccagtggctggggrtgctagacacccggcaccattctcccttctctcttttcttctcaggatttaaaatttaattatatcagtaaagagattaattttaacgtaactctttcta

SEQ ID NO: 4232 - DNA, 201 bp, Homo sapiens
ggcctgggtctccctggtggggtgtgcatgccacgccccgtgtctggatgcacagatgccatggcctgtgctgggccagtggctgggggtgctagacaccyggcaccattctcccttctctcttttcttctcaggatttaaaatttaattatatcagtaaagagattaattttaacgtaactctttctatgcccgtgtaaa

SEQ ID NO: 4233 - DNA, 201 bp, Homo sapiens
gggtggcgtctgcctaggagctggctggcaggtgttgggacctgctgctccatggatgcatgccctaagagtgtcactgagctgtgttttgtctgagcctytctcggtcaacagcaaagcttggtgtcttggcactgttagtgacagagcccagcatcccttctgcccccgttccagctgacatcttgcacggtgacccct

SEQ ID NO: 4234 - DNA, 201 bp, Homo sapiens
ggcgtctgcctaggagctggctggcaggtgttgggacctgctgctccatggatgcatgccctaagagtgtcactgagctgtgttttgtctgagcctctctyggtcaacagcaaagcttggtgtcttggcactgttagtgacagagcccagcatcccttctgcccccgttccagctgacatcttgcacggtgacccctttta

SEQ ID NO: 4235 - DNA, 201 bp, Homo sapiens
ctgagcctctctcggtcaacagcaaagcttggtgtcttggcactgttagtgacagagcccagcatcccttctgcccccgttccagctgacatcttgcacgktgaccccttttagtcaggagagtgcagatctgtgctcatcggagactgccccacggccctgtcagagccgccactcctatccccaggccaggtccctgga

SEQ ID NO: 4236 - DNA, 201 bp, Homo sapiens
tgtttgcaggcccagaggagccaagtcattaaaatggaagtggattctggatggccgggctgctgctgatgtaggagctggatttgggagctctgcttgcygactggctgtgagacgaggcaggggctctgcttcctcagccctagaggcgagccaggcaaggttggcgactgtcatgtggcttggtttggtcatgcccgt

SEQ ID NO: 4237 - DNA, 201 bp, Homo sapiens
atgtggtaagtggaggaaatgttggaactctgtgcaggtgctgccttgagacccccaagcttccacctgtccctctcctatgtggcagctggggagcagckgagatgtggacttgtatgctgcccacatacgtgagggggagctgaaagggagcccctcctctgagcagcctctgccaggcctgtatgaggcttttcccac

SEQ ID NO: 4238 - DNA, 201 bp, Homo sapiens
cccacccgcctcccgcctcccccgcaggttatgtcagcagctctgagacagcagtatcacaggccagatgttgttcctggctagatgtttacatttgtaaraaataacactgtgaatgtaaaacagagccattcccttggaatgcatatcgctgggctcaacatagagtttgtcttcctcttgtttacgacgtgatctaaa

SEQ ID NO: 4239 - DNA, 201 bp, Homo sapiens
ttccttagacccgccaggtcaagttagccgcgtgacggacatccaggcgtgggacgtggtcagggcagggctcattcattgcccactaggatcccactggmgaagatggtctccatatcagctctctgcagaagggaggaagactttatcatgttcctaaaaatctgtggcaagcacccatcgtattatccaaattttgtt

SEQ ID NO: 4240 - DNA, 201 bp, Homo sapiens
aatgtgcctcccttccgctgcgggcccagctgagtctatgtaggtgatgtttccagctgccaagtgctctttgttactgtccaccctcatttctgccagcrcatgtgtcctttcaaggggaaaatgtgaagctgaaccccctccagacacccagaatgtagcatctgagaaggccctgtgccctaaaggacacccctcgcc

SEQ ID NO: 4241 - DNA, 201 bp, Homo sapiens
cctcctcttggagctgagatgagccccacgtggagctcgggacggatagtagacagcaataactcggtgtgtggccgcctggcaggtggaacttcctcccrttgcggggtggagtgaggttagttctgtgtgtctggtgggtggagtcaggcttctcttgctacctgtgagcatccttcccagcagacatcctcatcgggc

SEQ ID NO: 4242 - DNA, 201 bp, Homo sapiens
gtgtctggtgggtggagtcaggcttctcttgctacctgtgagcatccttcccagcagacatcctcatcgggctttgtccctcccccgcttcctccctctgyggggaggacccgggaccacagctgctggccagggtagacttggagctgtcctccagaggggtcacgtgtaggagtgagaagaaggaagatcttgagagct

SEQ ID NO: 4243 - DNA, 201 bp, Homo sapiens
ggaccttggagagctcaggatggctcagacgaggacactcgcttgccgggcctgggcctcctgggaaggagggagctgctcagaatgccgcatgacaactraaggcaacctggaaggttcaggggccgctcttcccccatgtgcctgtcacgctctggtgcagtcaaaggaacgccttcccctcagttgtttctaagagca

SEQ ID NO: 4244 - DNA, 201 bp, Homo sapiens
gcctcctgggaaggagggagctgctcagaatgccgcatgacaactgaaggcaacctggaaggttcaggggccgctcttcccccatgtgcctgtcacgctcwggtgcagtcaaaggaacgccttcccctcagttgtttctaagagcagagtctcccgctgcaatctgggtggtaactgccagccttggaggatcgtggccaa

SEQ ID NO: 4245 - DNA, 201 bp, Homo sapiens
actgccagccttggaggatcgtggccaacgtggacctgcctacggagggtgggctctgacccaagtggggcctccttgtccaggtctcactgctttgcacrgtggtcagagggactgtcagctgagcttgagctcccctggagccagcagggctgtgatgggcgagtcccggagccccacccagacctgaatgcttctgag

SEQ ID NO: 4246 - DNA, 201 bp, Homo sapiens
gccttggaggatcgtggccaacgtggacctgcctacggagggtgggctctgacccaagtggggcctccttgtccaggtctcactgctttgcaccgtggtcrgagggactgtcagctgagcttgagctcccctggagccagcagggctgtgatgggcgagtcccggagccccacccagacctgaatgcttctgagagcaaag

SEQ ID NO: 4247 - DNA, 201 bp, Homo sapiens
actgctttgcaccgtggtcagagggactgtcagctgagcttgagctcccctggagccagcagggctgtgatgggcgagtcccggagccccacccagacctraatgcttctgagagcaaagggaaggactgacgagagatgtatatttaattttttaactgctgcaaacattgtacatccaaattaaaggaaaaaaatggaa

SEQ ID NO: 4248 - DNA, 201 bp, Homo sapiens; identical to SEQ ID NO: 4178

SEQ ID NO: 4249 - DNA, 201 bp, Homo sapiens; identical to SEQ ID NO: 4179

SEQ ID NO: 4250 - DNA, 201 bp, Homo sapiens; identical to SEQ ID NO: 4180

SEQ ID NO: 4251 - DNA, 201 bp, Homo sapiens; identical to SEQ ID NO: 4181

SEQ ID NO: 4252 - DNA, 201 bp, Homo sapiens; identical to SEQ ID NO: 4182

SEQ ID NO: 4253 - DNA, 201 bp, Homo sapiens; identical to SEQ ID NO: 4183

SEQ ID NO: 4254 - DNA, 201 bp, Homo sapiens; identical to SEQ ID NO: 4184

SEQ ID NO: 4255 - DNA, 201 bp, Homo sapiens; identical to SEQ ID NO: 4185

SEQ ID NO: 4256 - DNA, 201 bp, Homo sapiens; identical to SEQ ID NO: 4186

SEQ ID NO: 4257 - DNA, 201 bp, Homo sapiens; identical to SEQ ID NO: 4187

SEQ ID NO: 4258 - DNA, 201 bp, Homo sapiens; identical to SEQ ID NO: 4188

SEQ ID NO: 4259 - DNA, 201 bp, Homo sapiens; identical to SEQ ID NO: 4189

SEQ ID NO: 4260 - DNA, 201 bp, Homo sapiens
atcatacacagcaccaagaccacaatgttgtgaccggagccctggagctgttgcagcagctcttcagaacgcctccacccgagcttctgcaaaccctgacygcagtcgggggcattgggcagctcaccgctgctaaggaggagtctggtggccgaagccgtagtgggagtattgtggaacttataggcaactggagggggt

SEQ ID NO: 4261 - DNA, 201 bp, Homo sapiens; identical to SEQ ID NO: 4191

SEQ ID NO: 4262 - DNA, 201 bp, Homo sapiens; identical to SEQ ID NO: 4192

SEQ ID NO: 4263 - DNA, 201 bp, Homo sapiens; identical to SEQ ID NO: 4193

SEQ ID NO: 4264 - DNA, 201 bp, Homo sapiens; identical to SEQ ID NO: 4194

SEQ ID NO: 4265 - DNA, 201 bp, Homo sapiens; identical to SEQ ID NO: 4195

SEQ ID NO: 4266 - DNA, 201 bp, Homo sapiens; identical to SEQ ID NO: 4196

SEQ ID NO: 4267 - DNA, 201 bp, Homo sapiens; identical to SEQ ID NO: 4197

SEQ ID NO: 4268 - DNA, 201 bp, Homo sapiens; identical to SEQ ID NO: 4198

SEQ ID NO: 4269 - DNA, 201 bp, Homo sapiens; identical to SEQ ID NO: 4199

SEQ ID NO: 4270 - DNA, 201 bp, Homo sapiens; identical to SEQ ID NO: 4200

SEQ ID NO: 4271 - DNA, 201 bp, Homo sapiens; identical to SEQ ID NO: 4201

SEQ ID NO: 4272 - DNA, 201 bp, Homo sapiens; identical to SEQ ID NO: 4202

SEQ ID NO: 4273 - DNA, 201 bp, Homo sapiens; identical to SEQ ID NO: 4203

SEQ ID NO: 4274 - DNA, 201 bp, Homo sapiens; identical to SEQ ID NO: 4204

SEQ ID NO: 4275 - DNA, 201 bp, Homo sapiens; identical to SEQ ID NO: 4205

SEQ ID NO: 4276 - DNA, 201 bp, Homo sapiens; identical to SEQ ID NO: 4206

SEQ ID NO: 4277 - DNA, 201 bp, Homo sapiens; identical to SEQ ID NO: 4207

SEQ ID NO: 4278 - DNA, 201 bp, Homo sapiens; identical to SEQ ID NO: 4208

SEQ ID NO: 4279 - DNA, 201 bp, Homo sapiens; identical to SEQ ID NO: 4209

SEQ ID NO: 4280 - DNA, 201 bp, Homo sapiens; identical to SEQ ID NO: 4210

SEQ ID NO: 4281 - DNA, 201 bp, Homo sapiens; identical to SEQ ID NO: 4211

SEQ ID NO: 4282 - DNA, 201 bp, Homo sapiens; identical to SEQ ID NO: 4212

SEQ ID NO: 4283 - DNA, 130 bp, Homo sapiens; identical to SEQ ID NO: 4213

SEQ ID NO: 4284 - DNA, 201 bp, Homo sapiens; identical to SEQ ID NO: 4214

SEQ ID NO: 4285 - DNA, 201 bp, Homo sapiens; identical to SEQ ID NO: 4215

SEQ ID NO: 4286 - DNA, 201 bp, Homo sapiens; identical to SEQ ID NO: 4216

SEQ ID NO: 4287 - DNA, 201 bp, Homo sapiens; identical to SEQ ID NO: 4217

SEQ ID NO: 4288 - DNA, 201 bp, Homo sapiens; identical to SEQ ID NO: 4218

SEQ ID NO: 4289 - DNA, 201 bp, Homo sapiens; identical to SEQ ID NO: 4219

SEQ ID NO: 4290 - DNA, 201 bp, Homo sapiens; identical to SEQ ID NO: 4220

SEQ ID NO: 4291 - DNA, 201 bp, Homo sapiens; identical to SEQ ID NO: 4221

SEQ ID NO: 4292 - DNA, 201 bp, Homo sapiens; identical to SEQ ID NO: 4222

SEQ ID NO: 4293 - DNA, 201 bp, Homo sapiens; identical to SEQ ID NO: 4223

SEQ ID NO: 4294 - DNA, 201 bp, Homo sapiens; identical to SEQ ID NO: 4224

SEQ ID NO: 4295 - DNA, 201 bp, Homo sapiens; identical to SEQ ID NO: 4225

SEQ ID NO: 4296 - DNA, 201 bp, Homo sapiens; identical to SEQ ID NO: 4226

SEQ ID NO: 4297 - DNA, 201 bp, Homo sapiens; identical to SEQ ID NO: 4227

SEQ ID NO: 4298 - DNA, 201 bp, Homo sapiens; identical to SEQ ID NO: 4228

SEQ ID NO: 4299 - DNA, 201 bp, Homo sapiens; identical to SEQ ID NO: 4229

SEQ ID NO: 4300 - DNA, 201 bp, Homo sapiens; identical to SEQ ID NO: 4230

SEQ ID NO: 4301 - DNA, 201 bp, Homo sapiens; identical to SEQ ID NO: 4231

SEQ ID NO: 4302 - DNA, 201 bp, Homo sapiens; identical to SEQ ID NO: 4232

SEQ ID NO: 4303 - DNA, 201 bp, Homo sapiens; identical to SEQ ID NO: 4233

SEQ ID NO: 4304 - DNA, 201 bp, Homo sapiens; identical to SEQ ID NO: 4234

SEQ ID NO: 4305 - DNA, 201 bp, Homo sapiens; identical to SEQ ID NO: 4235

SEQ ID NO: 4306 - DNA, 201 bp, Homo sapiens; identical to SEQ ID NO: 4236

SEQ ID NO: 4307 - DNA, 201 bp, Homo sapiens; identical to SEQ ID NO: 4237

SEQ ID NO: 4308 - DNA, 201 bp, Homo sapiens; identical to SEQ ID NO: 4238

SEQ ID NO: 4309 - DNA, 201 bp, Homo sapiens; identical to SEQ ID NO: 4239

SEQ ID NO: 4310 - DNA, 201 bp, Homo sapiens; identical to SEQ ID NO: 4240

SEQ ID NO: 4311 - DNA, 201 bp, Homo sapiens; identical to SEQ ID NO: 4241

SEQ ID NO: 4312 - DNA, 201 bp, Homo sapiens; identical to SEQ ID NO: 4242

SEQ ID NO: 4313 - DNA, 201 bp, Homo sapiens; identical to SEQ ID NO: 4243

SEQ ID NO: 4314 - DNA, 201 bp, Homo sapiens; identical to SEQ ID NO: 4244

SEQ ID NO: 4315 - DNA, 201 bp, Homo sapiens; identical to SEQ ID NO: 4245

SEQ ID NO: 4316 - DNA, 201 bp, Homo sapiens; identical to SEQ ID NO: 4246

SEQ ID NO: 4317 - DNA, 201 bp, Homo sapiens; identical to SEQ ID NO: 4247

SEQ ID NO: 4318 - DNA, 201 bp, Homo sapiens; identical to SEQ ID NO: 4178

SEQ ID NO: 4319 - DNA, 201 bp, Homo sapiens; identical to SEQ ID NO: 4180

SEQ ID NO: 4320 - DNA, 201 bp, Homo sapiens; identical to SEQ ID NO: 4181

SEQ ID NO: 4321 - DNA, 201 bp, Homo sapiens; identical to SEQ ID NO: 4182

SEQ ID NO: 4322 - DNA, 201 bp, Homo sapiens; identical to SEQ ID NO: 4183

SEQ ID NO: 4323 - DNA, 201 bp, Homo sapiens; identical to SEQ ID NO: 4185

SEQ ID NO: 4324 - DNA, 201 bp, Homo sapiens; identical to SEQ ID NO: 4186

SEQ ID NO: 4325 - DNA, 201 bp, Homo sapiens; identical to SEQ ID NO: 4187

SEQ ID NO: 4326 - DNA, 201 bp, Homo sapiens; identical to SEQ ID NO: 4188

SEQ ID NO: 4327 - DNA, 201 bp, Homo sapiens; identical to SEQ ID NO: 4189

SEQ ID NO: 4328 - DNA, 201 bp, Homo sapiens; identical to SEQ ID NO: 4190

SEQ ID NO: 4329 - DNA, 201 bp, Homo sapiens; identical to SEQ ID NO: 4191

SEQ ID NO: 4330 - DNA, 201 bp, Homo sapiens; identical to SEQ ID NO: 4192

SEQ ID NO: 4331 - DNA, 201 bp, Homo sapiens; identical to SEQ ID NO: 4193

SEQ ID NO: 4332 - DNA, 201 bp, Homo sapiens; identical to SEQ ID NO: 4194

SEQ ID NO: 4333 - DNA, 201 bp, Homo sapiens; identical to SEQ ID NO: 4195

SEQ ID NO: 4334 - DNA, 201 bp, Homo sapiens; identical to SEQ ID NO: 4196

SEQ ID NO: 4335 - DNA, 201 bp, Homo sapiens; identical to SEQ ID NO: 4197

SEQ ID NO: 4336 - DNA, 201 bp, Homo sapiens; identical to SEQ ID NO: 4198

SEQ ID NO: 4337 - DNA, 201 bp, Homo sapiens; identical to SEQ ID NO: 4199

SEQ ID NO: 4338 - DNA, 201 bp, Homo sapiens; identical to SEQ ID NO: 4200

SEQ ID NO: 4339 - DNA, 201 bp, Homo sapiens; identical to SEQ ID NO: 4201

SEQ ID NO: 4340 - DNA, 201 bp, Homo sapiens; identical to SEQ ID NO: 4202

SEQ ID NO: 4341 - DNA, 201 bp, Homo sapiens; identical to SEQ ID NO: 4203

SEQ ID NO: 4342 - DNA, 201 bp, Homo sapiens; identical to SEQ ID NO: 4204

SEQ ID NO: 4343 - DNA, 201 bp, Homo sapiens; identical to SEQ ID NO: 4205

SEQ ID NO: 4344 - DNA, 201 bp, Homo sapiens; identical to SEQ ID NO: 4208

SEQ ID NO: 4345 - DNA, 201 bp, Homo sapiens; identical to SEQ ID NO: 4209

SEQ ID NO: 4346 - DNA, 201 bp, Homo sapiens; identical to SEQ ID NO: 4211

SEQ ID NO: 4347 - DNA, 201 bp, Homo sapiens; identical to SEQ ID NO: 4212

SEQ ID NO: 4348 - DNA, 130 bp, Homo sapiens; identical to SEQ ID NO: 4213

SEQ ID NO: 4349 - DNA, 201 bp, Homo sapiens; identical to SEQ ID NO: 4214

SEQ ID NO: 4350 - DNA, 201 bp, Homo sapiens; identical to SEQ ID NO: 4215

SEQ ID NO: 4351 - DNA, 201 bp, Homo sapiens; identical to SEQ ID NO: 4216

SEQ ID NO: 4352 - DNA, 201 bp, Homo sapiens; identical to SEQ ID NO: 4217

SEQ ID NO: 4353 - DNA, 201 bp, Homo sapiens; identical to SEQ ID NO: 4218

SEQ ID NO: 4354 - DNA, 201 bp, Homo sapiens; identical to SEQ ID NO: 4219

SEQ ID NO: 4355 - DNA, 201 bp, Homo sapiens; identical to SEQ ID NO: 4220

SEQ ID NO: 4356 - DNA, 201 bp, Homo sapiens; identical to SEQ ID NO: 4221

SEQ ID NO: 4357 - DNA, 201 bp, Homo sapiens; identical to SEQ ID NO: 4222

SEQ ID NO: 4358 - DNA, 201 bp, Homo sapiens; identical to SEQ ID NO: 4223

SEQ ID NO: 4359 - DNA, 201 bp, Homo sapiens; identical to SEQ ID NO: 4224

SEQ ID NO: 4360 - DNA, 201 bp, Homo sapiens; identical to SEQ ID NO: 4225

SEQ ID NO: 4361 - DNA, 201 bp, Homo sapiens; identical to SEQ ID NO: 4226

SEQ ID NO: 4362 - DNA, 201 bp, Homo sapiens; identical to SEQ ID NO: 4227

SEQ ID NO: 4363 - DNA, 201 bp, Homo sapiens; identical to SEQ ID NO: 4228

SEQ ID NO: 4364 - DNA, 201 bp, Homo sapiens; identical to SEQ ID NO: 4229

SEQ ID NO: 4365 - DNA, 201 bp, Homo sapiens; identical to SEQ ID NO: 4230

SEQ ID NO: 4366 - DNA, 201 bp, Homo sapiens; identical to SEQ ID NO: 4231

SEQ ID NO: 4367 - DNA, 201 bp, Homo sapiens; identical to SEQ ID NO: 4232

SEQ ID NO: 4368 - DNA, 201 bp, Homo sapiens; identical to SEQ ID NO: 4233

SEQ ID NO: 4369 - DNA, 201 bp, Homo sapiens; identical to SEQ ID NO: 4234

SEQ ID NO: 4370 - DNA, 201 bp, Homo sapiens; identical to SEQ ID NO: 4235

SEQ ID NO: 4371 - DNA, 201 bp, Homo sapiens; identical to SEQ ID NO: 4236

SEQ ID NO: 4372 - DNA, 201 bp, Homo sapiens; identical to SEQ ID NO: 4237

SEQ ID NO: 4373 - DNA, 201 bp, Homo sapiens; identical to SEQ ID NO: 4238

SEQ ID NO: 4374 - DNA, 201 bp, Homo sapiens; identical to SEQ ID NO: 4239

SEQ ID NO: 4375 - DNA, 201 bp, Homo sapiens; identical to SEQ ID NO: 4240

SEQ ID NO: 4376 - DNA, 201 bp, Homo sapiens; identical to SEQ ID NO: 4241

SEQ ID NO: 4377 - DNA, 201 bp, Homo sapiens; identical to SEQ ID NO: 4242

SEQ ID NO: 4378 - DNA, 201 bp, Homo sapiens; identical to SEQ ID NO: 4243

SEQ ID NO: 4379 - DNA, 201 bp, Homo sapiens; identical to SEQ ID NO: 4244

SEQ ID NO: 4380 - DNA, 201 bp, Homo sapiens; identical to SEQ ID NO: 4245

SEQ ID NO: 4381 - DNA, 201 bp, Homo sapiens; identical to SEQ ID NO: 4246

SEQ ID NO: 4382 - DNA, 201 bp, Homo sapiens; identical to SEQ ID NO: 4247

SEQ ID NO: 4383 - DNA, 201 bp, Homo sapiens; identical to SEQ ID NO: 4178

SEQ ID NO: 4384 - DNA, 201 bp, Homo sapiens; identical to SEQ ID NO: 4179

SEQ ID NO: 4385 - DNA, 201 bp, Homo sapiens; identical to SEQ ID NO: 4180

SEQ ID NO: 4386 - DNA, 201 bp, Homo sapiens; identical to SEQ ID NO: 4181

SEQ ID NO: 4387 - DNA, 201 bp, Homo sapiens; identical to SEQ ID NO: 4182

SEQ ID NO: 4388 - DNA, 201 bp, Homo sapiens; identical to SEQ ID NO: 4183

SEQ ID NO: 4389 - DNA, 201 bp, Homo sapiens; identical to SEQ ID NO: 4184

SEQ ID NO: 4390 - DNA, 201 bp, Homo sapiens; identical to SEQ ID NO: 4185

SEQ ID NO: 4391 - DNA, 201 bp, Homo sapiens; identical to SEQ ID NO: 4186

SEQ ID NO: 4392 - DNA, 201 bp, Homo sapiens; identical to SEQ ID NO: 4187

SEQ ID NO: 4393 - DNA, 201 bp, Homo sapiens; identical to SEQ ID NO: 4188

SEQ ID NO: 4394 - DNA, 201 bp, Homo sapiens; identical to SEQ ID NO: 4189

SEQ ID NO: 4395 - DNA, 201 bp, Homo sapiens; identical to SEQ ID NO: 4260

SEQ ID NO: 4396 - DNA, 201 bp, Homo sapiens; identical to SEQ ID NO: 4191

SEQ ID NO: 4397 - DNA, 201 bp, Homo sapiens; identical to SEQ ID NO: 4192

SEQ ID NO: 4398 - DNA, 201 bp, Homo sapiens; identical to SEQ ID NO: 4193

SEQ ID NO: 4399 - DNA, 201 bp, Homo sapiens; identical to SEQ ID NO: 4194

SEQ ID NO: 4400 - DNA, 201 bp, Homo sapiens; identical to SEQ ID NO: 4195

SEQ ID NO: 4401 - DNA, 201 bp, Homo sapiens; identical to SEQ ID NO: 4196

SEQ ID NO: 4402 - DNA, 201 bp, Homo sapiens; identical to SEQ ID NO: 4197

SEQ ID NO: 4403 - DNA, 201 bp, Homo sapiens; identical to SEQ ID NO: 4198

SEQ ID NO: 4404 - DNA, 201 bp, Homo sapiens; identical to SEQ ID NO: 4199

SEQ ID NO: 4405 - DNA, 201 bp, Homo sapiens; identical to SEQ ID NO: 4200

SEQ ID NO: 4406 - DNA, 201 bp, Homo sapiens; identical to SEQ ID NO: 4201

SEQ ID NO: 4407 - DNA, 201 bp, Homo sapiens; identical to SEQ ID NO: 4202

SEQ ID NO: 4408 - DNA, 201 bp, Homo sapiens; identical to SEQ ID NO: 4203

SEQ ID NO: 4409 - DNA, 201 bp, Homo sapiens; identical to SEQ ID NO: 4204

SEQ ID NO: 4410 - DNA, 201 bp, Homo sapiens; identical to SEQ ID NO: 4205

SEQ ID NO: 4411 - DNA, 201 bp, Homo sapiens; identical to SEQ ID NO: 4206

SEQ ID NO: 4412 - DNA, 201 bp, Homo sapiens; identical to SEQ ID NO: 4207

SEQ ID NO: 4413 - DNA, 201 bp, Homo sapiens; identical to SEQ ID NO: 4208

SEQ ID NO: 4414 - DNA, 201 bp, Homo sapiens; identical to SEQ ID NO: 4209

SEQ ID NO: 4415 - DNA, 201 bp, Homo sapiens; identical to SEQ ID NO: 4210

SEQ ID NO: 4416 - DNA, 201 bp, Homo sapiens; identical to SEQ ID NO: 4211

SEQ ID NO: 4417 - DNA, 201 bp, Homo sapiens; identical to SEQ ID NO: 4212

SEQ ID NO: 4418 - DNA, 130 bp, Homo sapiens; identical to SEQ ID NO: 4213

SEQ ID NO: 4419 - DNA, 201 bp, Homo sapiens; identical to SEQ ID NO: 4214

SEQ ID NO: 4420 - DNA, 201 bp, Homo sapiens; identical to SEQ ID NO: 4215

SEQ ID NO: 4421 - DNA, 201 bp, Homo sapiens; identical to SEQ ID NO: 4216

SEQ ID NO: 4422 - DNA, 201 bp, Homo sapiens; identical to SEQ ID NO: 4217

SEQ ID NO: 4423 - DNA, 201 bp, Homo sapiens; identical to SEQ ID NO: 4218

SEQ ID NO: 4424 - DNA, 201 bp, Homo sapiens; identical to SEQ ID NO: 4219

SEQ ID NO: 4425 - DNA, 201 bp, Homo sapiens; identical to SEQ ID NO: 4220

SEQ ID NO: 4426 - DNA, 201 bp, Homo sapiens; identical to SEQ ID NO: 4221

SEQ ID NO: 4427 - DNA, 201 bp, Homo sapiens; identical to SEQ ID NO: 4222

SEQ ID NO: 4428 - DNA, 201 bp, Homo sapiens; identical to SEQ ID NO: 4223

SEQ ID NO: 4429 - DNA, 201 bp, Homo sapiens; identical to SEQ ID NO: 4224

SEQ ID NO: 4430 - DNA, 201 bp, Homo sapiens; identical to SEQ ID NO: 4225

SEQ ID NO: 4431 - DNA, 201 bp, Homo sapiens; identical to SEQ ID NO: 4226

SEQ ID NO: 4432 - DNA, 201 bp, Homo sapiens; identical to SEQ ID NO: 4227

SEQ ID NO: 4433 - DNA, 201 bp, Homo sapiens; identical to SEQ ID NO: 4228

SEQ ID NO: 4434 - DNA, 201 bp, Homo sapiens; identical to SEQ ID NO: 4229

SEQ ID NO: 4435 - DNA, 201 bp, Homo sapiens; identical to SEQ ID NO: 4230

SEQ ID NO: 4436 - DNA, 201 bp, Homo sapiens; identical to SEQ ID NO: 4231

SEQ ID NO: 4437 - DNA, 201 bp, Homo sapiens; identical to SEQ ID NO: 4232

SEQ ID NO: 4438 - DNA, 201 bp, Homo sapiens; identical to SEQ ID NO: 4233

SEQ ID NO: 4439 - DNA, 201 bp, Homo sapiens; identical to SEQ ID NO: 4234

SEQ ID NO: 4440 - DNA, 201 bp, Homo sapiens; identical to SEQ ID NO: 4235

SEQ ID NO: 4441 - DNA, 201 bp, Homo sapiens; identical to SEQ ID NO: 4236

SEQ ID NO: 4442 - DNA, 201 bp, Homo sapiens; identical to SEQ ID NO: 4237

SEQ ID NO: 4443 - DNA, 201 bp, Homo sapiens; identical to SEQ ID NO: 4238

SEQ ID NO: 4444 - DNA, 201 bp, Homo sapiens; identical to SEQ ID NO: 4239

SEQ ID NO: 4445 - DNA, 201 bp, Homo sapiens
ggctgtggggagattgcttttgttttcctgctggtaatatcgggaaagattttaatgaaaccaggtggggcctccttgtccaggtctcactgctttgcacrgtggtcagagggactgtcagctgagcttgagctcccctggagccagcagggctgtgatgggcgagtcccggagccccacccagacctgaatgcttctgag

SEQ ID NO: 4446 - DNA, 201 bp, Homo sapiens
gggagattgcttttgttttcctgctggtaatatcgggaaagattttaatgaaaccaggtggggcctccttgtccaggtctcactgctttgcaccgtggtcrgagggactgtcagctgagcttgagctcccctggagccagcagggctgtgatgggcgagtcccggagccccacccagacctgaatgcttctgagagcaaag

SEQ ID NO: 4447 - DNA, 201 bp, Homo sapiens; identical to SEQ ID NO: 4247

SEQ ID NO: 4448 - DNA, 201 bp, Homo sapiens
agggcattgtggcccggctaacagagagcctgttcctggacctgctcggagaggagaatgggggcttttgccagcaggacatgggggagtcatgccttctyccaccttcgggaagtacgagtgctcacatgccctgggatgagttcccaagtgcagggcccaaggaggcacctccctggggcaaggagcagcctctccacc

SEQ ID NO: 4449 - DNA, 201 bp, Homo sapiens
gccccggtggagtgtgaggaggaggaggaggtagaggaagaaaaagggagcttctgtgcatcgcctgagagcagcagggatgacttccaggagggaagggmgggcattgtggcccggctaacagagagcctgttcctggacctgctcggagaggagaatgggggcttttgccagcaggacatgggggagtcatgccttctt

SEQ ID NO: 4450 - DNA, 201 bp, Homo sapiens
aagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagct

SEQ ID NO: 4451 - DNA, 201 bp, Homo sapiens
gcattgtcatcctggccgtctgcctgttgtgctatgtcagcatcaccaagattaagaaagaatggtgggatcagattcccaacccagcccgcagccgcctsgtggctataataatccaggatgctcaggggtcacagtgggagaagcggtcccgaggccaggaaccagccaagtgcccacactggaagaattgtcttacca

SEQ ID NO: 4452 - DNA, 201 bp, Homo sapiens
gggagggcattgtggcccggctaacagagagcctgttcctggacctgctcggagaggagaatgggggcttttgccagcaggacatgggggagtcatgcctycttccaccttcgggaagtacgagtgctcacatgccctgggatgagttcccaagtgcagggcccaaggaggcacctccctggggcaaggagcagcctctcc

SEQ ID NO: 4453 - DNA, 201 bp, Homo sapiens
gagagcatcagcgtggtgcgatgtgtggagttgtttgaggccccggtggagtgtgaggaggaggaggaggtagaggaagaaaaagggagcttctgtgcatygcctgagagcagcagggatgacttccaggagggaagggagggcattgtggcccggctaacagagagcctgttcctggacctgctcggagaggagaatggg

SEQ ID NO: 4454 - DNA, 201 bp, Homo sapiens
aagggagcttctgtgcatcgcctgagagcagcagggatgacttccaggagggaagggagggcattgtggcccggctaacagagagcctgttcctggacctkctcggagaggagaatgggggcttttgccagcaggacatgggggagtcatgccttcttccaccttcgggaagtacgagtgctcacatgccctgggatgagt

SEQ ID NO: 4455 - DNA, 201 bp, Homo sapiens
ctgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtga

SEQ ID NO: 4456 - DNA, 201 bp, Homo sapiens
aactatacactggacctgtgggctgggcagcagctgctgtggaagggctccttcaagcccagcgagcatgtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 4457 - DNA, 201 bp, Homo sapiens
atgtctccgacactctgctgctgacctggagcaacccgtatccccctgacaattacctgtataatcatctcacctatgcagtcaacatttggagtgaaaaygacccggcagatttcagaatctataacgtgacctacctagaaccctccctccgcatcgcagccagcaccctgaagtctgggatttcctacagggcacggg

SEQ ID NO: 4458 - DNA, 201 bp, Homo sapiens
ctcgccccctacaacccccctgagggccccagacccctctccaggtggggttccactggaggccagtctgtgtccggcctccctggcaccctcgggcatcycagagaagagtaaatcctcatcatccttccatcctgcccctggcaatgctcagagctcaagccagacccccaaaatcgtgaactttgtctccgtgggacc

SEQ ID NO: 4459 - DNA, 201 bp, Homo sapiens
ggagcttctgtgcatcgcctgagagcagcagggatgacttccaggagggaagggagggcattgtggcccggctaacagagagcctgttcctggacctgctyggagaggagaatgggggcttttgccagcaggacatgggggagtcatgccttcttccaccttcgggaagtacgagtgctcacatgccctgggatgagttcc

SEQ ID NO: 4460 - DNA, 201 bp, Homo sapiens
gggaagggagggcattgtggcccggctaacagagagcctgttcctggacctgctcggagaggagaatgggggcttttgccagcaggacatgggggagtcaygccttcttccaccttcgggaagtacgagtgctcacatgccctgggatgagttcccaagtgcagggcccaaggaggcacctccctggggcaaggagcagcc

SEQ ID NO: 4461 - DNA, 201 bp, Homo sapiens
ccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcat

SEQ ID NO: 4462 - DNA, 201 bp, Homo sapiens
gaagggagggcattgtggcccggctaacagagagcctgttcctggacctgctcggagaggagaatgggggcttttgccagcaggacatgggggagtcatgycttcttccaccttcgggaagtacgagtgctcacatgccctgggatgagttcccaagtgcagggcccaaggaggcacctccctggggcaaggagcagcctc

SEQ ID NO: 4463 - DNA, 201 bp, Homo sapiens
ccctggggaccctgccccagtccctgtccccttgttcacctttggactggacagggagccacctcgcagtccgcagagctcacatctcccaagcagctccycagagcacctgggtctggagccgggggaaaaggtagaggacatgccaaagcccccacttccccaggagcaggccacagacccccttgtggacagcctggg

SEQ ID NO: 4464 - DNA, 201 bp, Homo sapiens
aggatgctcaggggtcacagtgggagaagcggtcccgaggccaggaaccagccaagtgcccacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 4465 - DNA, 201 bp, Homo sapiens
ccccaacctgagccagaaacctgggagcagatcctccgccgaaatgtcctccagcatggggcagctgcagcccccgtctcggcccccaccagtggctatcrggagtttgtacatgcggtggagcagggtggcacccaggccagtgcggtggtgggcttgggtcccccaggagaggctggttacaaggccttctcaagcctg

SEQ ID NO: 4466 - DNA, 201 bp, Homo sapiens
gtggcccggctaacagagagcctgttcctggacctgctcggagaggagaatgggggcttttgccagcaggacatgggggagtcatgccttcttccaccttygggaagtacgagtgctcacatgccctgggatgagttcccaagtgcagggcccaaggaggcacctccctggggcaaggagcagcctctccacctggagcca

SEQ ID NO: 4467 - DNA, 201 bp, Homo sapiens
tgagccagaaacctgggagcagatcctccgccgaaatgtcctccagcatggggcagctgcagcccccgtctcggcccccaccagtggctatcaggagtttrtacatgcggtggagcagggtggcacccaggccagtgcggtggtgggcttgggtcccccaggagaggctggttacaaggccttctcaagcctgcttgccag

SEQ ID NO: 4468 - DNA, 200 bp, Homo sapiens
ctctacttgcgagtggaagatgaatggtcccaccaattgcagcaccgagctccgcctgttgtaccagctggtttttctgctctccgaagcccacacgtgttccctgagaacaacggaggcgcggggtgcgtgtgccacctgctcatggatgacgtggtcagtgcggataactatacactggacctgtgggctgggcagca

SEQ ID NO: 4469 - DNA, 201 bp, Homo sapiens
caaaatcgtgaactttgtctccgtgggacccacatacatgagggtctcttaggtgcatgtcctcttgttgctgagtctgcagatgaggactagggcttatycatgcctgggaaatgccacctcctggaaggcagccaggctggcagatttccaaaagacttgaagaaccatggtatgaaggtgattggccccactgacgtt

SEQ ID NO: 4470 - DNA, 201 bp, Homo sapiens
gagggtctcttaggtgcatgtcctcttgttgctgagtctgcagatgaggactagggcttatccatgcctgggaaatgccacctcctggaaggcagccaggstggcagatttccaaaagacttgaagaaccatggtatgaaggtgattggccccactgacgttggcctaacactgggctgcagagactggaccccgcccagc

SEQ ID NO: 4471 - DNA, 201 bp, Homo sapiens
actggaccccgcccagcattgggctgggctcgccacatcccatgagagtagagggcactgggtcgccgtgccccacggcaggcccctgcaggaaaactgargcccttgggcacctcgacttgtgaacgagttgttggctgctccctccacagcttctgcagcagactgtccctgttgtaactgcccaaggcatgttttgcc

SEQ ID NO: 4472 - DNA, 201 bp, Homo sapiens
gcccagcattgggctgggctcgccacatcccatgagagtagagggcactgggtcgccgtgccccacggcaggcccctgcaggaaaactgaggcccttgggmacctcgacttgtgaacgagttgttggctgctccctccacagcttctgcagcagactgtccctgttgtaactgcccaaggcatgttttgcccaccagatca

SEQ ID NO: 4473 - DNA, 201 bp, Homo sapiens
ttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatga

SEQ ID NO: 4474 - DNA, 201 bp, Homo sapiens
ttcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatggaacccccagaataaatatgctcagcc

SEQ ID NO: 4475 - DNA, 201 bp, Homo sapiens
agcaacagaggacatgaaaaattgctgtgactaaagcagggacaatttgctgccaaacacccatgcccagctgtatggctgggggctcctcgtatgcatgsaacccccagaataaatatgctcagccaccctgtgggccgggcaatccagacagcaggcataaggcaccagttaccctgcatgttggcccagacctcaggt

SEQ ID NO: 4476 - DNA, 201 bp, Homo sapiens
gactaaagcagggacaatttgctgccaaacacccatgcccagctgtatggctgggggctcctcgtatgcatggaacccccagaataaatatgctcagccaycctgtgggccgggcaatccagacagcaggcataaggcaccagttaccctgcatgttggcccagacctcaggtgctagggaaggcgggaaccttgggttga

SEQ ID NO: 4477 - DNA, 181 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 4478 - DNA, 182 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 4479 - DNA, 201 bp, Homo sapiens
gacggtgcatcccgggcgcctggcagtgtgacgggctgcctgactgcttcgacaagagtgatgagaaggagtgccccaaggctaagtcgaaatgtggcccraccttcttcccctgtgccagcggcatccattgcatcattggtcgcttccggtgcaatgggtttgaggactgtcccgatggcagcgatgaagagaactgca

SEQ ID NO: 4480 - DNA, 201 bp, Homo sapiens
ctgggtgacagagcaataacctgtctcagaaaaaggaggtacattttatggtatgtcaaaacatctgaataaaactagtatttaaaaaaaaaaaaccttgkgaaatacaatcagtatatacctctagttggccaaaatgatattcctcaatgactatttttacgattaaataactgacagatatttaagaaactgtttgaa

SEQ ID NO: 4481 - DNA, 201 bp, Homo sapiens
agttgtgactgccccactacactccagcctgggtgacagagcaataacctgtctcagaaaaaggaggtacattttatggtatgtcaaaacatctgaataawactagtatttaaaaaaaaaaaaccttgggaaatacaatcagtatatacctctagttggccaaaatgatattcctcaatgactatttttacgattaaataa

SEQ ID NO: 4482 - DNA, 201 bp, Homo sapiens
aaggaaattcagcagctgcaggacatgataacacagaatgatgatgatgttttcttccgggaactggaagctgagcgcttcagatctcggcttcagctggyttcctttcagtacagtaaaagtccctccctatgaggccagacttgataatagtaggtgaaggttctggaggcctttaccaggacagagctagaatcgagc

SEQ ID NO: 4483 - DNA, 201 bp, Homo sapiens
ctaatgaaatgctgtctaaaaaagccttagcctcaccaagttctaaatcacatgaagatatgttgtaccctcctagtgttttgtccaagagtaggacatcytttgttgaagacacggaaaccctttctgtgagtgggattccaaatgctaggaagctaggggagcctatccgagcagctattcctttacatccaccctacc

SEQ ID NO: 4484 - DNA, 201 bp, Homo sapiens
ctgatcgaggagaacgtttggaagagccagaaagtactaaagaatctaaatcatcatggaaaagagtttcttttgggaggtgctccttgtcttctgagatrttgggcccctcttgggatggagatgaagcagaatccactggtgaaatcattagacttggagacacagcacacaccttttctctaagaagtaatggtgctc

SEQ ID NO: 4485 - DNA, 201 bp, Homo sapiens
tgctcctctgatgaccaatcagcggcgagaagctcttttaacgtccgtccttctttcacgcctccttccccgcgctttggttcgtgcgtccgcgccccagygtcgggtctgcgtggatcggtccttccaggacaccgtcgccttcccggccgcgtcggagtccggcggcgacctgcctctgaaacatggcaggctcggatg

SEQ ID NO: 4486 - DNA, 201 bp, Homo sapiens; identical to SEQ ID NO: 4482

SEQ ID NO: 4487 - DNA, 201 bp, Homo sapiens; identical to SEQ ID NO: 4483

SEQ ID NO: 4488 - DNA, 201 bp, Homo sapiens; identical to SEQ ID NO: 4484

SEQ ID NO: 4489 - DNA, 201 bp, Homo sapiens; identical to SEQ ID NO: 4485

SEQ ID NO: 4490 - DNA, 201 bp, Homo sapiens; identical to SEQ ID NO: 4485

SEQ ID NO: 4491 - DNA, 201 bp, Homo sapiens
ttatttacattgccctggcctttttggcggaatcaaagtccctacatagccaaggagatcttttaccttctacactagtgggaggccaggtgcctgggagrgaggtggcacgcccccgccctcctctggcatgccactgtcctgctgtgaaagcctgtgtcaaggaaaactgggctcagaggtgcagactgagagagccgc

SEQ ID NO: 4492 - DNA, 201 bp, Homo sapiens
ctgtgtcaaggaaaactgggctcagaggtgcagactgagagagccgctgggctgttttgaaggaaggtaagcagagagcatttgtgtgtgtgtgtgtgtgygcgcgcgtgcatatgtgtatgtgtgtctgtgcctgtgtggtgagtgtgtgtgtgcatgtgtgtggcttctgtaatgctacaaagacctgaaactgagctg

SEQ ID NO: 4493 - DNA, 201 bp, Homo sapiens
gtgtcaaggaaaactgggctcagaggtgcagactgagagagccgctgggctgttttgaaggaaggtaagcagagagcatttgtgtgtgtgtgtgtgtgcgygcgcgtgcatatgtgtatgtgtgtctgtgcctgtgtggtgagtgtgtgtgtgcatgtgtgtggcttctgtaatgctacaaagacctgaaactgagctgtg

SEQ ID NO: 4494 - DNA, 201 bp, Homo sapiens
ctggaggagtcttaacttactgacttctttttggggaagagtcagtgatggtctgacatgctgtttgcaagctctctggccgcctctgtggccagccggcrtgggtggcctcagataaggccaacaggacctcctcttttcctctgggcttgggcccctgtgttttcagttaggagtgcccaaaagggaactgagctgccc

SEQ ID NO: 4495 - DNA, 201 bp, Homo sapiens
gcctcagataaggccaacaggacctcctcttttcctctgggcttgggcccctgtgttttcagttaggagtgcccaaaagggaactgagctgcccagtcagrggcctgagataggcgcctgctgaatgctgagcctgcaccggcgtgctggtgtgagaggtctgcccggggagccgccctggcctgccctgctgtcagtgcg

SEQ ID NO: 4496 - DNA, 200 bp, Homo sapiens
aggggcctgagataggcgcctgctgaatgctgagcctgcaccggcgtgctggtgtgagaggtctgcccggggagccgccctggcctgccctgctgtcagtcggctgtgggggcaccttggcggcgtctgtgacacgcctgccacagccccactcggagcacagtgctcctttatcgccacattccagagcctcacccagg

SEQ ID NO: 4497 - DNA, 201 bp, Homo sapiens
ttgtgagccagctgacagcacattggcagcttgggatctgccagggcgggattgtttacaccacaggatttagcaaacgttatgaatcaacccctccatcrgccccaagcttccctgacacaccaaacagtagaaattcactgccttttttttttttttttttaactctgcttggtgttagctaactagtcatgaagaata

SEQ ID NO: 4498 - DNA, 201 bp, Homo sapiens
tgctgttaggagaacagagcatccatatgaagggcggttccctgagctggggagaccagtgacaactgtaagtctgggttcagagcatgagtcgggggacrgagaaggcccctgggcatctggccctgggtggctgagccctgggaatcctgcttttcccagagatgtgcttgtgcccagtgtgctcatgttttaaatgcc

SEQ ID NO: 4499 - DNA, 201 bp, Homo sapiens
acggcagagtggtgtctggtgggtcctctcctgacatttcttctctctctggtcaaatgctggatgcacacatatagtggctctgagacttcctatctggrtgagctcaggcagttctagggacctctctgagccctagtttcatgtcctgtacaacagtagtcattcctactgcacatggttcttgagaagattggacca

SEQ ID NO: 4500 - DNA, 201 bp, Homo sapiens
tggggccctcaagcgggagcgtcagtggcagccctcgccatcgtccgtctgttgaatgtattgccacatggccacattatgccccaggagccatgtgttgkaggacagtatccttaggcttctcagaaattccacatgggagcctcaaatggacatgcttttcttgaaaacaaaaatatttgtaaaaatgtaacaatggga

SEQ ID NO: 4501 - DNA, 201 bp, Homo sapiens
tgagaaagccctcagtgtccgcccagatgcaggcctatgggcagagcagctactccacacagacctgggtgcgccagcagcagatggttgtagctcaccastatagcttcgccccagatggggaggcccggctggtgagccgctgccctgcagacaatcctggcctcgtccaggcccagcccagagtgccactcaccccca

SEQ ID NO: 4502 - DNA, 201 bp, Homo sapiens
tccatcacgcccttggccttgccgtgcaagctgcttatcccagagagagatccattggaggaaatagcagaaagttctccccagacggcagccaattcagyagctgagctgttgaagcagggggcagcctgcaacgtgtggtacttgaactctgtggagatggagtccctcaccggccaccaggcgatccagaaggccctg

SEQ ID NO: 4503 - DNA, 201 bp, Homo sapiens
ccaggccttcctgggcttcggcaccgccccagtgggaagtggccttccgcccgaggaggacctgggggccttgctggccaattctcatggagcgtcaccgrcccccagcatcccgctgacagcgacaggggctgccgacaatggcttcctgtcccacaactttctcacggtggcgcctggacacagcagccaccacagtcc

SEQ ID NO: 4504 - DNA, 201 bp, Homo sapiens
agagatatgaccttacgaagcttaacccaaagatcatggatgtgggctggccagagctccacgcaccgcccctggataagatgtgtaccatatgcaaggcrcaggagtcctggctgaacagcaacctccagcatgtggtcgtcattcactgcaggggcgggaaaggacgcataggagtggtcatatcatcctacatgcatt

SEQ ID NO: 4505 - DNA, 201 bp, Homo sapiens
tgatcctggagctggatcccaccttcgagcccatccctacccacatgaacgccctcggtagccaggccaatggctctgtgtctccagacagcgtgggaggygggctccgggcaagcagcaggctgcctgacacaggagagggccccagcagggccaccgggcggcaaggctcctctgctgaacagcccctgggcgggagac

SEQ ID NO: 4506 - DNA, 201 bp, Homo sapiens
tttggtcagaagagccaaactcaacatctgtggctttggcaaaagtcaggctccagggagttccacgctgtccagttctctctgccgtgataaacctctgyggcccgtcatcctgagtcccaccatggaggagggccatgggctggacctcacttacatcacggagcgcatcatcgctgtgtccttccctgccggctgctc

SEQ ID NO: 4507 - DNA, 201 bp, Homo sapiens
ctcttctgcagaacgccagtgggtggagagcagccccaagcccatggtttccctgctggggagcggccggcccaccggaagtcccctcagcgctgagttcyccggtaccaggaaggactccccagtgctgtcctgcttcccgccgtcagagctccaggctcctttccacagccatgagctgtccctagcagagccaccgga

SEQ ID NO: 4508 - DNA, 201 bp, Homo sapiens
cggtcaaggtatttcatgccgagcctgcaagtattcctgccacaagaaatgtgaagccaaggcagagccttccacctccttctctgggccccgctcccaarctccccaagcacggaccgactcagaggtttccatccttgaggtctaccagttctttgaagcagagagaagagtttcaaggatcctgttagatcagcatcc

SEQ ID NO: 4509 - DNA, 201 bp, Homo sapiens
gctcctcttctgcagaacgccagtgggtggagagcagccccaagcccatggtttccctgctggggagcggccggcccaccggaagtcccctcagcgctgarttctccggtaccaggaaggactccccagtgctgtcctgcttcccgccgtcagagctccaggctcctttccacagccatgagctgtccctagcagagccac

SEQ ID NO: 4510 - DNA, 201 bp, Homo sapiens
atggcagaattttaagtagcaaggagtccatgtgttcaactccagcatttcctgtgtctccagagacaccgtatgtgaaaacagcgctgcgccatcctccrttcagcccacctgagcccccgctgagcagcccagccagtcagcacaaaggaggacgtgaaccacgaagctgccctgagacgctcactcacgctgtgggga

SEQ ID NO: 4511 - DNA, 201 bp, Homo sapiens
tgagctgtccctagcagagccaccggactccctggcgcctcccagcagccaggccttcctgggcttcggcaccgccccagtgggaagtggccttccgcccraggaggacctgggggccttgctggccaattctcatggagcgtcaccgacccccagcatcccgctgacagcgacaggggctgccgacaatggcttcctgtc

SEQ ID NO: 4512 - DNA, 201 bp, Homo sapiens
gggtgtaggcagtgggccacatccccctgacacacagcagccctctcccagcaaagcgttcaaacccaggtttccaggagaccaggttgtgaatggagccrgcccagagctgagcacaggcccctccccaggctcgcccaccctggacatcgaccagtccatcgagcagctcaacaggctgatcctggagctggatcccac

SEQ ID NO: 4513 - DNA, 201 bp, Homo sapiens
ttatcccagagagagatccattggaggaaatagcagaaagttctccccagacggcagccaattcagcagctgagctgttgaagcagggggcagcctgcaaygtgtggtacttgaactctgtggagatggagtccctcaccggccaccaggcgatccagaaggccctgagcatcaccctggtccaggagcctccacctgtgt

SEQ ID NO: 4514 - DNA, 201 bp, Homo sapiens
gcagtgactccggccactctacagcctctgccaggacggataagacggaagagcgcctggccccaggaaccaggaggggcctgagtgcccaggagaaggcwgagttggaccagctgctcagtggctttggcctggaagatcctggaagctccctcaaggaaatgactgatgctcgaagcaagtacagtgggacccgccacg

SEQ ID NO: 4515 - DNA, 201 bp, Homo sapiens
ggcttcggcaccgccccagtgggaagtggccttccgcccgaggaggacctgggggccttgctggccaattctcatggagcgtcaccgacccccagcatccmgctgacagcgacaggggctgccgacaatggcttcctgtcccacaactttctcacggtggcgcctggacacagcagccaccacagtccaggcctgcagggc

SEQ ID NO: 4516 - DNA, 201 bp, Homo sapiens
aaatgtgcatggggaaaggctggtgtggactatgccccaaacctgccgccattcccctcaccagcggacgtcaaagagacgatgacccctggctatccccmggacctcgatattatcgatggcagaattttaagtagcaaggagtccatgtgttcaactccagcatttcctgtgtctccagagacaccgtatgtgaaaaca

SEQ ID NO: 4517 - DNA, 201 bp, Homo sapiens
tgttagatcagcatccaggtgttccatttggtcagaagagccaaactcaacatctgtggctttggcaaaagtcaggctccagggagttccacgctgtccarttctctctgccgtgataaacctctgcggcccgtcatcctgagtcccaccatggaggagggccatgggctggacctcacttacatcacggagcgcatcatc

SEQ ID NO: 4518 - DNA, 201 bp, Homo sapiens
ggaaggaggatctggacaatgccagcaaagatgaccgttttcctgactatgggaaggttgaattagtcttctctgccacgcctgagaagattcaagggtcygaacacttgtacaacgaccacggtgtgattgtggactacaacacaacagacccactgatacgctgggactcgtacgagaacctcagtgcagatggagaag

SEQ ID NO: 4519 - DNA, 201 bp, Homo sapiens
cgcccgcgcgctactcggagcccagcctcgttgcggccatcgccctgccggaccgcgcctcaggctcccccagccggaagaattaacctcgagtctgcacrcttttaagaacaaggcctttaaaaaatccaaagtgtgtggagtttgcaaacaaattattgacggtcaaggtatttcatgccgagcctgcaagtattcctg

SEQ ID NO: 4520 - DNA, 201 bp, Homo sapiens
agggtggggcccccactttttaccaaactagtaaacctgacattccaggcccatgaggggaaagaggatcttccagctctgcaaaaacaagaacaaacaayatcaccgtgaattggcctttcctgaaagtgacttatctgacacatctctgtagccacatgctttttgggtagaagaagctgggcatgggtgcaccccacc

SEQ ID NO: 4521 - DNA, 201 bp, Homo sapiens
ggcccccactttttaccaaactagtaaacctgacattccaggcccatgaggggaaagaggatcttccagctctgcaaaaacaagaacaaacaacatcaccktgaattggcctttcctgaaagtgacttatctgacacatctctgtagccacatgctttttgggtagaagaagctgggcatgggtgcaccccaccccctagg

SEQ ID NO: 4522 - DNA, 201 bp, Homo sapiens
tgggtgcaccccaccccctagggtccccatgggaaagggacatgcaaggaaacagcacagaacacgaggtggtccccatgtccctggcacactagcattcygggggatgaggaatccccagcccttgaggcagaggtgccgagtgactgccatgcttcgcccgtccgcatgggcgcttctgtccagctgcacccgaggccg

SEQ ID NO: 4523 - DNA, 201 bp, Homo sapiens
ttgtgcaagtcaggcccttctggaacacagcagggcctacaacgaggggcctttgcgatgggctgtgaggatgggggtggtgggaagaattggccacgttrgagaccccatgccaccccaccatggtgagtgctctgtgcctcctgctcacctgtggtgagctgggcgagctgggcgagctgggcgagctgggctggggag

SEQ ID NO: 4524 - DNA, 201 bp, Homo sapiens
gctgtgaggatgggggtggtgggaagaattggccacgttagagaccccatgccaccccaccatggtgagtgctctgtgcctcctgctcacctgtggtgagytgggcgagctgggcgagctgggcgagctgggctggggagagcctgtgaggaccgagaggagaaatgagaagaaggaacaaaaatattatttctatgtaat

SEQ ID NO: 4525 - DNA, 201 bp, Homo sapiens
cctcaagcaacctaccctgatgttttactcattggaatgtttttccccgattgtggatgacttcttttctgatggagagagtccaggagggatggaaaackcctggatttaagctcagcatcccccacatgggcttttcgatcatcttcaggcctgaagctgcacgacctgaagttcgcctgcatttatcagccctctttg

SEQ ID NO: 4526 - DNA, 201 bp, Homo sapiens
tcatcttcaggcctgaagctgcacgacctgaagttcgcctgcatttatcagccctctttgtgctgctccttgccaccttggggttcctgctggggaccatstgtggttgtggcatgtgtgagcagaagggaggatgaggaaaaagagaagaaaccccggtactgacaagctgtttttgagtgccactgtttgccatcatct

SEQ ID NO: 4527 - DNA, 201 bp, Homo sapiens
aggaaaaagagaagaaaccccggtactgacaagctgtttttgagtgccactgtttgccatcatctaagccactgaatcaagtgtatttcaggcttatttcwacattccaatgccctggttttcctgcttgaatctgttcgtggtcaaaggtttgggggaatttgtgaccctggaacatccccagagtgaaagatggagctg

SEQ ID NO: 4528 - DNA, 201 bp, Homo sapiens
caggtgtgatttttacacaaggtaaacgtggtcaagggcatcggggaatttgctccaagcagatagctccctctgaggaaccaaaggaagcaagtttccaygatttctgaagagctggtataggaagtttctttcttccttttgtgttacatgtgcattaaacagaacaagctgtgtgtcatcacagattgtactgtgggc

SEQ ID NO: 4529 - DNA, 201 bp, Homo sapiens; identical to SEQ ID NO: 4502

SEQ ID NO: 4530 - DNA, 201 bp, Homo sapiens; identical to SEQ ID NO: 4503

SEQ ID NO: 4531 - DNA, 201 bp, Homo sapiens; identical to SEQ ID NO: 4507

SEQ ID NO: 4532 - DNA, 201 bp, Homo sapiens; identical to SEQ ID NO: 4509

SEQ ID NO: 4533 - DNA, 201 bp, Homo sapiens; identical to SEQ ID NO: 4511

SEQ ID NO: 4534 - DNA, 201 bp, Homo sapiens; identical to SEQ ID NO: 4513

SEQ ID NO: 4535 - DNA, 201 bp, Homo sapiens; identical to SEQ ID NO: 4515

SEQ ID NO: 4536 - DNA, 201 bp, Homo sapiens; identical to SEQ ID NO: 4520

SEQ ID NO: 4537 - DNA, 201 bp, Homo sapiens; identical to SEQ ID NO: 4521

SEQ ID NO: 4538 - DNA, 201 bp, Homo sapiens; identical to SEQ ID NO: 4522

SEQ ID NO: 4539 - DNA, 201 bp, Homo sapiens; identical to SEQ ID NO: 4523

SEQ ID NO: 4540 - DNA, 201 bp, Homo sapiens; identical to SEQ ID NO: 4524

SEQ ID NO: 4541 - DNA, 201 bp, Homo sapiens; identical to SEQ ID NO: 4525

SEQ ID NO: 4542 - DNA, 201 bp, Homo sapiens; identical to SEQ ID NO: 4526

SEQ ID NO: 4543 - DNA, 201 bp, Homo sapiens; identical to SEQ ID NO: 4527

SEQ ID NO: 4544 - DNA, 201 bp, Homo sapiens; identical to SEQ ID NO: 4528

SEQ ID NO: 4545 - DNA, 201 bp, Homo sapiens; identical to SEQ ID NO: 4504

SEQ ID NO: 4546 - DNA, 201 bp, Homo sapiens
tgaagccaaggtggtgattccctgcggtgtgcaagtccgactggaacaggctccagggagttccacgctgtccagttctctctgccgtgataaacctctgyggcccgtcatcctgagtcccaccatggaggagggccatgggctggacctcacttacatcacggagcgcatcatcgctgtgtccttccctgccggctgctc

SEQ ID NO: 4547 - DNA, 201 bp, Homo sapiens
tgcaagtattcctgccacaagaaatgtgaagccaaggtggtgattccctgcggtgtgcaagtccgactggaacaggctccagggagttccacgctgtccarttctctctgccgtgataaacctctgcggcccgtcatcctgagtcccaccatggaggagggccatgggctggacctcacttacatcacggagcgcatcatc

SEQ ID NO: 4548 - DNA, 201 bp, Homo sapiens; identical to SEQ ID NO: 4518

SEQ ID NO: 4549 - DNA, 201 bp, Homo sapiens; identical to SEQ ID NO: 4519

SEQ ID NO: 4550 - DNA, 201 bp, Homo sapiens; identical to SEQ ID NO: 4528

SEQ ID NO: 4551 - DNA, 201 bp, Homo sapiens; identical to SEQ ID NO: 4501

SEQ ID NO: 4552 - DNA, 201 bp, Homo sapiens; identical to SEQ ID NO: 4502

SEQ ID NO: 4553 - DNA, 201 bp, Homo sapiens; identical to SEQ ID NO: 4503

SEQ ID NO: 4554 - DNA, 201 bp, Homo sapiens; identical to SEQ ID NO: 4504

SEQ ID NO: 4555 - DNA, 201 bp, Homo sapiens; identical to SEQ ID NO: 4505

SEQ ID NO: 4556 - DNA, 201 bp, Homo sapiens; identical to SEQ ID NO: 4546

SEQ ID NO: 4557 - DNA, 201 bp, Homo sapiens; identical to SEQ ID NO: 4507

SEQ ID NO: 4558 - DNA, 201 bp, Homo sapiens; identical to SEQ ID NO: 4509

SEQ ID NO: 4559 - DNA, 201 bp, Homo sapiens; identical to SEQ ID NO: 4510

SEQ ID NO: 4560 - DNA, 201 bp, Homo sapiens; identical to SEQ ID NO: 4511

SEQ ID NO: 4561 - DNA, 201 bp, Homo sapiens; identical to SEQ ID NO: 4512

SEQ ID NO: 4562 - DNA, 201 bp, Homo sapiens; identical to SEQ ID NO: 4513

SEQ ID NO: 4563 - DNA, 201 bp, Homo sapiens; identical to SEQ ID NO: 4514

SEQ ID NO: 4564 - DNA, 201 bp, Homo sapiens; identical to SEQ ID NO: 4515

SEQ ID NO: 4565 - DNA, 201 bp, Homo sapiens; identical to SEQ ID NO: 4516

SEQ ID NO: 4566 - DNA, 201 bp, Homo sapiens; identical to SEQ ID NO: 4547

SEQ ID NO: 4567 - DNA, 201 bp, Homo sapiens; identical to SEQ ID NO: 4518

SEQ ID NO: 4568 - DNA, 201 bp, Homo sapiens; identical to SEQ ID NO: 4519

SEQ ID NO: 4569 - DNA, 201 bp, Homo sapiens; identical to SEQ ID NO: 4520

SEQ ID NO: 4570 - DNA, 201 bp, Homo sapiens; identical to SEQ ID NO: 4521

SEQ ID NO: 4571 - DNA, 201 bp, Homo sapiens; identical to SEQ ID NO: 4522

SEQ ID NO: 4572 - DNA, 201 bp, Homo sapiens; identical to SEQ ID NO: 4523

SEQ ID NO: 4573 - DNA, 201 bp, Homo sapiens; identical to SEQ ID NO: 4524

SEQ ID NO: 4574 - DNA, 201 bp, Homo sapiens; identical to SEQ ID NO: 4525

SEQ ID NO: 4575 - DNA, 201 bp, Homo sapiens; identical to SEQ ID NO: 4526

SEQ ID NO: 4576 - DNA, 201 bp, Homo sapiens; identical to SEQ ID NO: 4527

SEQ ID NO: 4577 - DNA, 201 bp, Homo sapiens; identical to SEQ ID NO: 4528

SEQ ID NO: 4578 - DNA, 201 bp, Homo sapiens; identical to SEQ ID NO: 4502

SEQ ID NO: 4579 - DNA, 201 bp, Homo sapiens; identical to SEQ ID NO: 4503

SEQ ID NO: 4580 - DNA, 201 bp, Homo sapiens; identical to SEQ ID NO: 4507

SEQ ID NO: 4581 - DNA, 201 bp, Homo sapiens; identical to SEQ ID NO: 4509

SEQ ID NO: 4582 - DNA, 201 bp, Homo sapiens; identical to SEQ ID NO: 4511

SEQ ID NO: 4583 - DNA, 201 bp, Homo sapiens; identical to SEQ ID NO: 4513

SEQ ID NO: 4584 - DNA, 201 bp, Homo sapiens; identical to SEQ ID NO: 4515

SEQ ID NO: 4585 - DNA, 185 bp, Homo sapiens
ggggctgtcacgttcctcttgttcttccctagtgtgagtagtcatccaggtaaatcattagccgtctttgaggtcatgagtcacccagggtctgtctaggyatttttctgtcattaaatacgtcctgggaaccacataggaactcttagcatttgtttgcaaggctatttttcttagaaatcagt

SEQ ID NO: 4586 - DNA, 201 bp, Homo sapiens
caaagaatcatgcaaaaaattaagaaaaccaaaacgcaaccaaggcgaattcaattgcatttttttttcccagcgacactttctgagacacgaacctctcwcttcggcgaacctattccagggcgcccttcattttcatttcttgaaacaacagccttgcaggccgagccgctgttcccgagaactcggcagccacaggga

SEQ ID NO: 4587 - DNA, 201 bp, Homo sapiens
gctgcacgctctgcttggcctcgccatgccggtggacctcagcaagtggtccgggcccttgagcctgcaagaagtggacgagcagccgcagcacccgctgmatgtcacctacgccggggcggcggtggacgagctgggcaaagtgctgacgcccacccaggttaagaatagacccaccagcatttcgtgggatggtcttga

SEQ ID NO: 4588 - DNA, 201 bp, Homo sapiens
aaggtggcgtccttccgtaaaaagtatgagctcagggccccggtggctggcacgtgttaccaggccgagtgggatgactatgtgcccaaactgtacgagcmgctgtctgggaagtagggggttagcttggggacctgaactgtcctggaggccccaagccatgttccccagttcagtgttgcatgtataatagatttctcc

SEQ ID NO: 4589 - DNA, 201 bp, Homo sapiens
gggctgggcggcggctgaggcgcgtgctctcgcgtggtcgctgggtctgcgtcttcccgagccagtgtgctgagctctccgcgtcgcctctgtcgcccgckcctggcctaccgcggcactcccggctgcacgctctgcttggcctcgccatgccggtggacctcagcaagtggtccgggcccttgagcctgcaagaagtgg

SEQ ID NO: 4590 - DNA, 201 bp, Homo sapiens
gctgagctctccgcgtcgcctctgtcgcccgcgcctggcctaccgcggcactcccggctgcacgctctgcttggcctcgccatgccggtggacctcagcargtggtccgggcccttgagcctgcaagaagtggacgagcagccgcagcacccgctgcatgtcacctacgccggggcggcggtggacgagctgggcaaagtg

SEQ ID NO: 4591 - DNA, 201 bp, Homo sapiens
ctggctggtttacgagcaggacaggccgctaaagtgtgacgagcccatcctcagcaaccgatctggagaccaccgtggcaaattcaaggtggcgtccttcmgtaaaaagtatgagctcagggccccggtggctggcacgtgttaccaggccgagtgggatgactatgtgcccaaactgtacgagcagctgtctgggaagta

SEQ ID NO: 4592 - DNA, 201 bp, Homo sapiens
ttcatttcttgaaacaacagccttgcaggccgagccgctgttcccgagaactcggcagccacagggagcaggttgcatggacccaggagcgcgagaggccytgctctgccagcttcggccaatcagaggccagggagcggtgggcgtgacgtggggcggtgcgcggggctgggcggcggctgaggcgcgtgctctcgcgtg

SEQ ID NO: 4593 - DNA, 201 bp, Homo sapiens
ggcggtgcgcggggctgggcggcggctgaggcgcgtgctctcgcgtggtcgctgggtctgcgtcttcccgagccagtgtgctgagctctccgcgtcgcctytgtcgcccgcgcctggcctaccgcggcactcccggctgcacgctctgcttggcctcgccatgccggtggacctcagcaagtggtccgggcccttgagcct

SEQ ID NO: 4594 - DNA, 201 bp, Homo sapiens
gggaagctctacaccttggtcctgacagacccggatgctcccagcaggaaggatcccaaatacagagaatggcatcatttcctggtggtcaacatgaaggrcaatgacatcagcagtggcacagtcctctccgattatgtgggctcggggcctcccaagggcacaggcctccaccgctatgtctggctggtttacgagcag

SEQ ID NO: 4595 - DNA, 201 bp, Homo sapiens
tcccaagggcacaggcctccaccgctatgtctggctggtttacgagcaggacaggccgctaaagtgtgacgagcccatcctcagcaaccgatctggagacyaccgtggcaaattcaaggtggcgtccttccgtaaaaagtatgagctcagggccccggtggctggcacgtgttaccaggccgagtgggatgactatgtgcc

SEQ ID NO: 4596 - DNA, 201 bp, Homo sapiens
accgtggcaaattcaaggtggcgtccttccgtaaaaagtatgagctcagggccccggtggctggcacgtgttaccaggccgagtgggatgactatgtgccmaaactgtacgagcagctgtctgggaagtagggggttagcttggggacctgaactgtcctggaggccccaagccatgttccccagttcagtgttgcatgta

SEQ ID NO: 4597 - DNA, 201 bp, Homo sapiens
atgccggtggacctcagcaagtggtccgggcccttgagcctgcaagaagtggacgagcagccgcagcacccgctgcatgtcacctacgccggggcggcggyggacgagctgggcaaagtgctgacgcccacccaggttaagaatagacccaccagcatttcgtgggatggtcttgattcagggaagctctacaccttggtc

SEQ ID NO: 4598 - DNA, 201 bp, Homo sapiens
cacgtgttaccaggccgagtgggatgactatgtgcccaaactgtacgagcagctgtctgggaagtagggggttagcttggggacctgaactgtcctggagsccccaagccatgttccccagttcagtgttgcatgtataatagatttctcctcttcctgccccccttggcatgggtgagacctgaccagtcagatggtagt

SEQ ID NO: 4599 - DNA, 201 bp, Homo sapiens
atcaaatttgaacttcattttggggggtattttggtactgtgatggggtcatcaaattattaatctgaaaatagcaacccagaatgtaaaaaagaaaaaaytggggggaaaaagaccaggtctacagtgatagagcaaagcatcaaagaatctttaaggaaggtttaaaaaaaaaaaaaaaaaaaaagattacctccaaca

SEQ ID NO: 4600 - DNA, 201 bp, Homo sapiens
tattttggtactgtgatggggtcatcaaattattaatctgaaaatagcaacccagaatgtaaaaaagaaaaaactggggggaaaaagaccaggtctacagwgatagagcaaagcatcaaagaatctttaaggaaggtttaaaaaaaaaaaaaaaaaaaaagattacctccaacacagtgcatctcagatgcctcagtaggc

SEQ ID NO: 4601 - DNA, 201 bp, Homo sapiens
ttaatctgaaaatagcaacccagaatgtaaaaaagaaaaaactggggggaaaaagaccaggtctacagtgatagagcaaagcatcaaagaatctttaaggraggtttaaaaaaaaaaaaaaaaaaaaagattacctccaacacagtgcatctcagatgcctcagtaggcatcagtatgtcactctggtccctttaaagagc

SEQ ID NO: 4602 - DNA, 201 bp, Homo sapiens
aaagattacctccaacacagtgcatctcagatgcctcagtaggcatcagtatgtcactctggtccctttaaagagcaatcctggaagaagcaggagggagkgtggctttgctgttgttgggacatggcaatctagaccggcagcagcgctcgctgacagcttgggaggaaacctgagatctgtgttttttaaattgatcgt

SEQ ID NO: 4603 - DNA, 201 bp, Homo sapiens
aggcatcagtatgtcactctggtccctttaaagagcaatcctggaagaagcaggagggagggtggctttgctgttgttgggacatggcaatctagaccggyagcagcgctcgctgacagcttgggaggaaacctgagatctgtgttttttaaattgatcgttcttcatgggggtaagaaaagctggtctggagttgctgaa

SEQ ID NO: 4604 - DNA, 201 bp, Homo sapiens; identical to SEQ ID NO: 4586

SEQ ID NO: 4605 - DNA, 201 bp, Homo sapiens; identical to SEQ ID NO: 4587

SEQ ID NO: 4606 - DNA, 201 bp, Homo sapiens; identical to SEQ ID NO: 4588

SEQ ID NO: 4607 - DNA, 201 bp, Homo sapiens; identical to SEQ ID NO: 4589

SEQ ID NO: 4608 - DNA, 201 bp, Homo sapiens; identical to SEQ ID NO: 4590

SEQ ID NO: 4609 - DNA, 201 bp, Homo sapiens; identical to SEQ ID NO: 4591

SEQ ID NO: 4610 - DNA, 201 bp, Homo sapiens; identical to SEQ ID NO: 4592

SEQ ID NO: 4611 - DNA, 201 bp, Homo sapiens; identical to SEQ ID NO: 4593

SEQ ID NO: 4612 - DNA, 201 bp, Homo sapiens; identical to SEQ ID NO: 4594

SEQ ID NO: 4613 - DNA, 201 bp, Homo sapiens; identical to SEQ ID NO: 4595

SEQ ID NO: 4614 - DNA, 201 bp, Homo sapiens; identical to SEQ ID NO: 4596

SEQ ID NO: 4615 - DNA, 201 bp, Homo sapiens; identical to SEQ ID NO: 4597

SEQ ID NO: 4616 - DNA, 201 bp, Homo sapiens; identical to SEQ ID NO: 4598

SEQ ID NO: 4617 - DNA, 201 bp, Homo sapiens
atcaaatttgaacttcattttggggggtattttggtactgtgatggggtcatcaaattattaatctgaaaatagcaacccagaatgtaaaaaagaaaaaaytggggggaaaaagaccaggtctacagtgatagagcaaagcatcaaagaatctttaaggaaggtttaaaaaaaaaaaaaaaaaaaaagattggttgcctct

SEQ ID NO: 4618 - DNA, 201 bp, Homo sapiens
tattttggtactgtgatggggtcatcaaattattaatctgaaaatagcaacccagaatgtaaaaaagaaaaaactggggggaaaaagaccaggtctacagwgatagagcaaagcatcaaagaatctttaaggaaggtttaaaaaaaaaaaaaaaaaaaaagattggttgcctctgcctttgtgatcctgagtccagaatgg

SEQ ID NO: 4619 - DNA, 201 bp, Homo sapiens
ttaatctgaaaatagcaacccagaatgtaaaaaagaaaaaactggggggaaaaagaccaggtctacagtgatagagcaaagcatcaaagaatctttaaggraggtttaaaaaaaaaaaaaaaaaaaaagattggttgcctctgcctttgtgatcctgagtccagaatggtacacaatgtgattttatggtgatgtcactca

SEQ ID NO: 4620 - DNA, 201 bp, Homo sapiens
gaggctaacctccaacacagtgcatctcagatgcctcagtaggcatcagtatgtcactctggtccctttaaagagcaatcctggaagaagcaggagggagkgtggctttgctgttgttgggacatggcaatctagaccggcagcagcgctcgctgacagcttgggaggaaacctgagatctgtgttttttaaattgatcgt

SEQ ID NO: 4621 - DNA, 201 bp, Homo sapiens; identical to SEQ ID NO: 4603

SEQ ID NO: 4622 - DNA, 159 bp, Homo sapiens
gacctctggaaggagactgtatttaccaagtctccctatcaggaattcactgaccacctcgttaagacccacaccagagtctccgtgcagcggactcaggmtccagctgtggctacaacatagggtttttatacaagaaaaataaagtgaattaagcgt

SEQ ID NO: 4623 - DNA, 176 bp, Homo sapiens
caaatggcggatgacgccggtgcagcgggggggcggggccggggccgaggccgcggagctcgcggaggcaaggccraggataaggagtggatgcccgtcaccaagttgggccgcttggtcaaggacatgaagatcaagtccctggaggagatctatctcttctccctgcccattaa

SEQ ID NO: 4624 - DNA, 201 bp, Homo sapiens
aggccgaggataaggagtggatgcccgtcaccaagttgggccgcttggtcaaggacatgaagatcaagtccctggaggagatctatctcttctccctgccyattaaggaatcagagatcattgatttcttcctgggggcctctctcaaggatgaggttttgaagattatgccagtgcagaagcagacccgccgctgcggct

SEQ ID NO: 4625 - DNA, 195 bp, Homo sapiens
gacctctggaaggagactgtatttaccaagtctccctatcaggaattcactgaccacctcgttaagacccacaccagagtctccgtgcagcggactcaggmtccagctgtggctacaacatagggtttttatacaagaaaaataaagtgaattaagcgtgaaaaaaaaattataaaagaatttataccagaatat

SEQ ID NO: 4626 - DNA, 201 bp, Homo sapiens
gtgttaagtgctccaaggaggtggccaccgccatccgtggggccatcatcctggccaagctctccattgtccccgtgcgcagaggctactgggggaacaakatcggcaagccccacactgtcccttgcaaggtgacaggccgctgcggctctgtgctggtgcgcctcatccctgcacccaggggcactggcatcgtctccg

SEQ ID NO: 4627 - DNA, 201 bp, Homo sapiens
aaaacaacaaatggcggatgacgccggtgcagcgggggggcacggaggccctggtggccctgggatggggaaccgcggtggcttccgcggaggcaaggccraggataaggagtggatgcccgtcaccaagttgggccgcttggtcaaggacatgaagatcaagtccctggaggagatctatctcttctccctgcccattaa

SEQ ID NO: 4628 - DNA, 201 bp, Homo sapiens
aggccgaggataaggagtggatgcccgtcaccaagttgggccgcttggtcaaggacatgaagatcaagtccctggaggagatctatctcttctccctgccyattaaggaatcagagatcattgatttcttcctgggggcctctctcaaggatgaggttttgaagattatgccagtgcagaagcagacccgtgccggccagc

SEQ ID NO: 4629 - DNA, 201 bp, Homo sapiens
cctgcccattaaggaatcagagatcattgatttcttcctgggggcctctctcaaggatgaggttttgaagattatgccagtgcagaagcagacccgtgccrgccagcgcaccaggttcaaggcgtttgttgctatcggggactacaatggccacgtcggtctgggtgttaagtgctccaaggaggtggccaccgccatccg

SEQ ID NO: 4630 - DNA, 201 bp, Homo sapiens
gatgaggttttgaagattatgccagtgcagaagcagacccgtgccggccagcgcaccagctctccattgtccccgtgcgcagaggctactgggggaacaakatcggcaagccccacactgtcccttgcaaggtgacaggccgctgcggctctgtgctggtgcgcctcatccctgcacccaggggcactggcatcgtctccg

SEQ ID NO: 4631 - DNA, 201 bp, Homo sapiens
cggtggcttccgcggaggtttcggcagtggcatccggggccggggtcgcggccgtggacggggccggggccgaggccgcggagctcgcggaggcaaggccraggataaggagtggatgcccgtcaccaagttgggccgcttggtcaaggacatgaagatcaagtccctggaggagatctatctcttctccctgcccattaa

SEQ ID NO: 4632 - DNA, 201 bp, Homo sapiens; identical to SEQ ID NO: 4628

SEQ ID NO: 4633 - DNA, 201 bp, Homo sapiens
cctgcccattaaggaatcagagatcattgatttcttcctgggggcctctctcaaggatgaggttttgaagattatgccagtgcagaagcagacccgtgccrgccagcgcaccagctctccattgtccccgtgcgcagaggctactgggggaacaagatcggcaagccccacactgtcccttgcaaggtgacaggccgctgc

SEQ ID NO: 4634 - DNA, 161 bp, Homo sapiens
gacctctggaaggagactgtatttaccaagtctccctatcaggaattcactgaccacctcgttaagacccacaccagagtctccgtgcagcggactcaggmtccagctgtggctacaacatagggtttttatacaagaaaaataaagtgaattaagcgtga

SEQ ID NO: 4635 - DNA, 195 bp, Homo sapiens; identical to SEQ ID NO: 4625

SEQ ID NO: 4636 - DNA, 201 bp, Homo sapiens; identical to SEQ ID NO: 4626

SEQ ID NO: 4637 - DNA, 201 bp, Homo sapiens
aatggcggatgacgccggtgcagcgggggggcacggaggccctggtggccctgggatggggaaccgcggtggcttccgcggagctcgcggaggcaaggccraggataaggagtggatgcccgtcaccaagttgggccgcttggtcaaggacatgaagatcaagtccctggaggagatctatctcttctccctgcccattaa

SEQ ID NO: 4638 - DNA, 201 bp, Homo sapiens; identical to SEQ ID NO: 4628

SEQ ID NO: 4639 - DNA, 201 bp, Homo sapiens; identical to SEQ ID NO: 4629

SEQ ID NO: 4640 - DNA, 195 bp, Homo sapiens; identical to SEQ ID NO: 4625

SEQ ID NO: 4641 - DNA, 201 bp, Homo sapiens; identical to SEQ ID NO: 4626

SEQ ID NO: 4642 - DNA, 201 bp, Homo sapiens; identical to SEQ ID NO: 4631

SEQ ID NO: 4643 - DNA, 201 bp, Homo sapiens; identical to SEQ ID NO: 4628

SEQ ID NO: 4644 - DNA, 201 bp, Homo sapiens; identical to SEQ ID NO: 4629

SEQ ID NO: 4645 - DNA, 195 bp, Homo sapiens; identical to SEQ ID NO: 4625

SEQ ID NO: 4646 - DNA, 201 bp, Homo sapiens; identical to SEQ ID NO: 4626

SEQ ID NO: 4647 - DNA, 201 bp, Homo sapiens
cggtggcttccgcggaggtttcggcagtggcatccggggccggggtcgcggccgtggacggggccggggccgaggccgcggagctcgcggaggcaaggccraggataaggagaatcagagatcattgatttcttcctgggggcctctctcaaggatgaggttttgaagattatgccagtgcagaagcagacccgtgccggc

SEQ ID NO: 4648 - DNA, 201 bp, Homo sapiens
ccgaggataaggagaatcagagatcattgatttcttcctgggggcctctctcaaggatgaggttttgaagattatgccagtgcagaagcagacccgtgccrgccagcgcaccaggttcaaggcgtttgttgctatcggggactacaatggccacgtcggtctgggtgttaagtgctccaaggaggtggccaccgccatccg

SEQ ID NO: 4649 - DNA, 195 bp, Homo sapiens; identical to SEQ ID NO: 4625

SEQ ID NO: 4650 - DNA, 201 bp, Homo sapiens; identical to SEQ ID NO: 4626

SEQ ID NO: 4651 - DNA, 201 bp, Homo sapiens; identical to SEQ ID NO: 4631

SEQ ID NO: 4652 - DNA, 201 bp, Homo sapiens
aggccgaggataaggagtggatgcccgtcaccaagttgggccgcttggtcaaggacatgaagatcaagtccctggaggagatctatctcttctccctgccyattaagttcaaggcgtttgttgctatcggggactacaatggccacgtcggtctgggtgttaagtgctccaaggaggtggccaccgccatccgtggggcca

SEQ ID NO: 4653 - DNA, 160 bp, Homo sapiens
cttcgccaaggccacctttgatgccatttctaagacctacagctacctgacccccgacctctggaaggagactgtatttaccaagtctccctatcaggagmtccagctgtggctacaacatagggtttttatacaagaaaaataaagtgaattaagcgtg

SEQ ID NO: 4654 - DNA, 201 bp, Homo sapiens; identical to SEQ ID NO: 4626

SEQ ID NO: 4655 - DNA, 201 bp, Homo sapiens; identical to SEQ ID NO: 4631

SEQ ID NO: 4656 - DNA, 201 bp, Homo sapiens; identical to SEQ ID NO: 4628

SEQ ID NO: 4657 - DNA, 201 bp, Homo sapiens; identical to SEQ ID NO: 4629

SEQ ID NO: 4658 - DNA, 159 bp, Homo sapiens; identical to SEQ ID NO: 4622

SEQ ID NO: 4659 - DNA, 201 bp, Homo sapiens; identical to SEQ ID NO: 4631

SEQ ID NO: 4660 - DNA, 201 bp, Homo sapiens; identical to SEQ ID NO: 4624

SEQ ID NO: 4661 - DNA, 195 bp, Homo sapiens; identical to SEQ ID NO: 4625

SEQ ID NO: 4662 - DNA, 201 bp, Homo sapiens; identical to SEQ ID NO: 4626

SEQ ID NO: 4663 - DNA, 170 bp, Homo sapiens
atggcggatgacgccggtgcagcgggggggcacggaggccctggccgcggagctcgcggaggcaaggccraggataaggagtggatgcccgtcaccaagttgggccgcttggtcaaggacatgaagatcaagtccctggaggagatctatctcttctccctgcccattaa

SEQ ID NO: 4664 - DNA, 201 bp, Homo sapiens; identical to SEQ ID NO: 4628

SEQ ID NO: 4665 - DNA, 201 bp, Homo sapiens; identical to SEQ ID NO: 4629

SEQ ID NO: 4666 - DNA, 201 bp, Homo sapiens; identical to SEQ ID NO: 4631

SEQ ID NO: 4667 - DNA, 201 bp, Homo sapiens; identical to SEQ ID NO: 4628

SEQ ID NO: 4668 - DNA, 201 bp, Homo sapiens
cctgcccattaaggaatcagagatcattgatttcttcctgggggcctctctcaaggatgaggttttgaagattatgccagtgcagaagcagacccgtgccrgccagcgcaccaggttcaaggcgtgacaggccgctgcggctctgtgctggtgcgcctcatccctgcacccaggggcactggcatcgtctccgcacctgtg

SEQ ID NO: 4669 - DNA, 164 bp, Homo sapiens
gacctctggaaggagactgtatttaccaagtctccctatcaggaattcactgaccacctcgttaagacccacaccagagtctccgtgcagcggactcaggmtccagctgtggctacaacatagggtttttatacaagaaaaataaagtgaattaagcgtgaaaa

SEQ ID NO: 4670 - DNA, 201 bp, Homo sapiens
atgtactatttcttagctatgttggcagctacagacctcggagtgacattgaccacaatgcccacagtgctaggtgttctgtggttagatcacagggagaytggccatggagcctgcttctctcaggcctattttatccatactctttctgtcatggagtcaggtgtcttgcttgccatggcttatgactgtttcattacc

SEQ ID NO: 4671 - DNA, 201 bp, Homo sapiens
ggagcctgcttctctcaggcctattttatccatactctttctgtcatggagtcaggtgtcttgcttgccatggcttatgactgtttcattaccatccacarccccttaagatatacctctatcctgaccaacacccaggtaatgaagattggtgtgcgggtattgacaagggctggtctgtccattatgccaatagttgtt

SEQ ID NO: 4672 - DNA, 201 bp, Homo sapiens
gattggccatggagcctgcttctctcaggcctattttatccatactctttctgtcatggagtcaggtgtcttgcttgccatggcttatgactgtttcattrccatccacaaccccttaagatatacctctatcctgaccaacacccaggtaatgaagattggtgtgcgggtattgacaagggctggtctgtccattatgcc

SEQ ID NO: 4673 - DNA, 201 bp, Homo sapiens
ggtaatgaagattggtgtgcgggtattgacaagggctggtctgtccattatgccaatagttgttcgcctacactggtttccctactgtcgatcccatgtaytctcccatgctttctgtctacaccaagatgtcatcaagctagcctgtgctgacatcaccttcaaccgtctctatccagttgtagttttatttgcaatggt

SEQ ID NO: 4674 - DNA, 201 bp, Homo sapiens
tgttcgcctacactggtttccctactgtcgatcccatgtactctcccatgctttctgtctacaccaagatgtcatcaagctagcctgtgctgacatcaccytcaaccgtctctatccagttgtagttttatttgcaatggtcttgttggactttctcatcatctttttctcctacattttgattctcaagactgtcatggg

SEQ ID NO: 4675 - DNA, 201 bp, Homo sapiens
caagactgtcatgggcattggttctggaggagaaagggccaaggccctcaacacatgtgtctctcatatctgctgcatcctggtcttctatgtcactgtastttgtctgacatttattcataggtttggaaagcatgttcctcatgtcgttcacatcacaatgagctacatccacttccttttcccaccttttatgaaccc

SEQ ID NO: 4676 - DNA, 114 bp, Homo sapiens
atggggctcaatamgtctgcttccaccttccagcttactggcttcccaggcatggagaaggcacatcactggatattcatcccattattggcagcctacatctccatacttctt

SEQ ID NO: 4677 - DNA, 201 bp, Homo sapiens
caacacccaggtaatgaagattggtgtgcgggtattgacaagggctggtctgtccattatgccaatagttgttcgcctacactggtttccctactgtcgakcccatgtactctcccatgctttctgtctacaccaagatgtcatcaagctagcctgtgctgacatcaccttcaaccgtctctatccagttgtagttttatt

SEQ ID NO: 4678 - DNA, 201 bp, Homo sapiens
catggagcctgcttctctcaggcctattttatccatactctttctgtcatggagtcaggtgtcttgcttgccatggcttatgactgtttcattaccatccrcaaccccttaagatatacctctatcctgaccaacacccaggtaatgaagattggtgtgcgggtattgacaagggctggtctgtccattatgccaatagtt

SEQ ID NO: 4679 - DNA, 201 bp, Homo sapiens
ccttccagcttactggcttcccaggcatggagaaggcacatcactggatattcatcccattattggcagcctacatctccatacttcttggcagtggcacwcttctctttctcatcaggaatgatcataacctccatgagcccatgtactatttcttagctatgttggcagctacagacctcggagtgacattgaccacaa

SEQ ID NO: 4680 - DNA, 201 bp, Homo sapiens
caggcctattttatccatactctttctgtcatggagtcaggtgtcttgcttgccatggcttatgactgtttcattaccatccacaaccccttaagatatayctctatcctgaccaacacccaggtaatgaagattggtgtgcgggtattgacaagggctggtctgtccattatgccaatagttgttcgcctacactggttt

SEQ ID NO: 4681 - DNA, 201 bp, Homo sapiens
atatctgctgcatcctggtcttctatgtcactgtagtttgtctgacatttattcataggtttggaaagcatgttcctcatgtcgttcacatcacaatgagmtacatccacttccttttcccaccttttatgaacccatttatctatagcattaaaactaagcagattcagagtggcatacttcgtttattctctctgcctc

SEQ ID NO: 4682 - DNA, 131 bp, Homo sapiens
ttcacatcacaatgagctacatccacttccttttcccaccttttatgaacccatttatctatagcattaaaactaagcagattcagagtggcatacttcgyttattctctctgcctcactctagagcatga

SEQ ID NO: 4683 - DNA, 201 bp, Homo sapiens
gcttccaccttccagcttactggcttcccaggcatggagaaggcacatcactggatattcatcccattattggcagcctacatctccatacttcttggcartggcactcttctctttctcatcaggaatgatcataacctccatgagcccatgtactatttcttagctatgttggcagctacagacctcggagtgacattg

SEQ ID NO: 4684 - DNA, 201 bp, Homo sapiens
tgtcttgcttgccatggcttatgactgtttcattaccatccacaaccccttaagatatacctctatcctgaccaacacccaggtaatgaagattggtgtgsgggtattgacaagggctggtctgtccattatgccaatagttgttcgcctacactggtttccctactgtcgatcccatgtactctcccatgctttctgtct

SEQ ID NO: 4685 - DNA, 201 bp, Homo sapiens
actgtcgatcccatgtactctcccatgctttctgtctacaccaagatgtcatcaagctagcctgtgctgacatcaccttcaaccgtctctatccagttgtrgttttatttgcaatggtcttgttggactttctcatcatctttttctcctacattttgattctcaagactgtcatgggcattggttctggaggagaaaggg

SEQ ID NO: 4686 - DNA, 118 bp, Homo sapiens
tgcaggcctgaggcccagccagcgcccaatggatgacaaaaagaagaaacggagtcccaagccctgcctggcccagccagcccaggccccaggcacactayggagggtccctgtgcct

SEQ ID NO: 4687 - DNA, 201 bp, Homo sapiens
tgaacaagagggtacaggacctgagtgctggtggccagggctccctcactgacagtggccctgagaggaggccagaggggcctggggctcaagcacccagstcccccagggtcacagaagcgccttgctacccaggagcaccgagcacagaagcatcaggccagactgggcctcaagagcccacctccgccagggcctaga

SEQ ID NO: 4688 - DNA, 201 bp, Homo sapiens
tgaaggtgtttttttctttatttctttttctttttttttttttttctttttcttttttttttgcacatgacagtgtttgtattgaggaccttccaaggaaragggatgctgtagcagtggtgcctgggtgcctggcctccagtgtcccacctccttcaccaccccacttggctcctttgccatcttgatgctgaggtttcc

SEQ ID NO: 4689 - DNA, 201 bp, Homo sapiens
ttttctgggacaacagaatgactcagaccaagatggataggatggttagggctttgcttcttgctgtttttctttgaagctagttcattgtcctgcaggtmccttcatcttccatacctagcccactcttttagcccttaccttaaatctctcagataagttggttcacaaagaatgttaagtactgaatcatgtgtgact

SEQ ID NO: 4690 - DNA, 201 bp, Homo sapiens
agaggtatgcaccttcccccttgaagagaggggaaaggcctacagtggcccacataattgcctgactcacacttcagctacctcttaatgcctgtggaggractggagctgctggatcccagtgtggtggtgtaggaggccacagtgagcaggtggccccagctgggtttcccaggtcaggaatgtgggccccaggcaagg

SEQ ID NO: 4691 - DNA, 201 bp, Homo sapiens
ttaatgcctgtggagggactggagctgctggatcccagtgtggtggtgtaggaggccacagtgagcaggtggccccagctgggtttcccaggtcaggaatrtgggccccaggcaaggtgcagcctttgctcacagctccatccatgtctagaccttcaggccagtctgcagatgaggttccctacctttttcttctcttca

SEQ ID NO: 4692 - DNA, 201 bp, Homo sapiens
tcagggccttgtccagctgagagcttcatgtccaccagattctgagaggtgtcagcagcactttttttttttatttgttgtttgttttccatgaggttatyggaccatgggctgagctcaggcactttctgtaggagactgttatttctgtaaagatggttatttaaccctcctccaccccatcacggtggccctgagggc

SEQ ID NO: 4693 - DNA, 201 bp, Homo sapiens
ttctgtaggagactgttatttctgtaaagatggttatttaaccctcctccaccccatcacggtggccctgagggctgacccggaggccagtggagctgccwggtgtccacgggggagggccaaggcctgctgagctgattctccagctgctgccccagcctttccgccttgcacagcacagaggtggtcaccccagggaca

SEQ ID NO: 4694 - DNA, 201 bp, Homo sapiens
cacggtggccctgagggctgacccggaggccagtggagctgcctggtgtccacgggggagggccaaggcctgctgagctgattctccagctgctgccccakcctttccgccttgcacagcacagaggtggtcaccccagggacagccaggcacctgctcctcttgcccttcctgggggaagggagctgccttctgtccctg

SEQ ID NO: 4695 - DNA, 201 bp, Homo sapiens
cagctgctgccccagcctttccgccttgcacagcacagaggtggtcaccccagggacagccaggcacctgctcctcttgcccttcctgggggaagggagckgccttctgtccctgtaactgctttccttatggcccagcccggccactcagacttgtttgaagctgcactggcagcttttttgtctcctttgggtattcac

SEQ ID NO: 4696 - DNA, 201 bp, Homo sapiens
ccgccaagaccagagagccgttggcgccctccgcccgggcctgccggtccgtttattttaagaagctttgtgcgcctgctgtggggatttctgatccaggytgcgaagaatttcgaagtctggaaaatagcaactgtgtttgtttctaaaggatcttctcctgacccagcatcgctcatcacaatgaagaaccaagacaaa

SEQ ID NO: 4697 - DNA, 201 bp, Homo sapiens; identical to SEQ ID NO: 4687

SEQ ID NO: 4698 - DNA, 201 bp, Homo sapiens; identical to SEQ ID NO: 4688

SEQ ID NO: 4699 - DNA, 201 bp, Homo sapiens; identical to SEQ ID NO: 4689

SEQ ID NO: 4700 - DNA, 201 bp, Homo sapiens; identical to SEQ ID NO: 4690

SEQ ID NO: 4701 - DNA, 201 bp, Homo sapiens; identical to SEQ ID NO: 4691

SEQ ID NO: 4702 - DNA, 201 bp, Homo sapiens; identical to SEQ ID NO: 4692

SEQ ID NO: 4703 - DNA, 201 bp, Homo sapiens; identical to SEQ ID NO: 4693

SEQ ID NO: 4704 - DNA, 201 bp, Homo sapiens; identical to SEQ ID NO: 4694

SEQ ID NO: 4705 - DNA, 201 bp, Homo sapiens; identical to SEQ ID NO: 4695

SEQ ID NO: 4706 - DNA, 201 bp, Homo sapiens
ccaagctccagcaggcccaggagatgctaaaggaggcagaagagcggcaccagcgggagaaggattttgtgaggctcaggccccagggttggggtgggggkgtgggaggagacaggctgggctctggctcagctcatagccgggttatatgggagaagtctggccagaccaggcacagattccttgagtaccagtctgaga

SEQ ID NO: 4707 - DNA, 201 bp, Homo sapiens
gggagtccatcatatcagattgagatggggggctgggcaaagtgccctggtctgtggctgtggggctaccctgagaaagggagcgcctgacaagccgactrctcccaccatctttgttgcagcatatcgacaaagtcttcaaacacaaggacctacaacagcagctggtggatgccaagctccagcaggcccaggagatgc

SEQ ID NO: 4708 - DNA, 201 bp, Homo sapiens
acacagagaagtttgaggagttccagaacacactttccaaaagcagcgaggtattcaccacattcaagcaggagatggaaaaggtaactgtggtccaggcyaggcatggctgctggggcataagctgcttcattcaaaattgttgggcctgccttcaggaagctcccatctggggtgtctcaagggcagggctgttaggaa

SEQ ID NO: 4709 - DNA, 201 bp, Homo sapiens
caggcccaggagatgctaaaggaggcagaagagcggcaccagcgggagaaggattttgtgaggctcaggccccagggttggggtgggggtgtgggaggagrcaggctgggctctggctcagctcatagccgggttatatgggagaagtctggccagaccaggcacagattccttgagtaccagtctgagagcaggaagcct

SEQ ID NO: 4710 - DNA, 201 bp, Homo sapiens
tccttggggatgcacatgtctagtctttgcctagatatggcaagtctttgccaactgagctaggctgttatgttcttagaggcattgtttttgcccattcytcccatttacaagagaatcagggacacagaagtgagggcttccagccccataggtgatcaatcctggggtcagagatttgagtgtgtttattgcttgcct

SEQ ID NO: 4711 - DNA, 201 bp, Homo sapiens
aagctccagcaggcccaggagatgctaaaggaggcagaagagcggcaccagcgggagaaggattttgtgaggctcaggccccagggttggggtgggggtgtgggaggagacaggctgggctctggctcagctcatagccgggttatatgggagaagtctggccagaccaggcacagattccttgagtaccagtctgagagc

SEQ ID NO: 4712 - DNA, 201 bp, Homo sapiens
agctccagcaggcccaggagatgctaaaggaggcagaagagcggcaccagcgggagaaggattttgtgaggctcaggccccagggttggggtgggggtgtgggaggagacaggctgggctctggctcagctcatagccgggttatatgggagaagtctggccagaccaggcacagattccttgagtaccagtctgagagca

SEQ ID NO: 4713 - DNA, 201 bp, Homo sapiens
ctactggttcatctcccgggacaaagaggaaactttgccacttgaagatgggtggtgggggccaggcacgaggtccgcagccagggaggacgacagcatcygccctttcaaggtggaaacgtcagatgaggagatccacgacttacaccagaggatcgataagttccgtttcaccccacctttggaggacagctgcttcca

SEQ ID NO: 4714 - DNA, 201 bp, Homo sapiens
acattcaaggaggggactgggggtccctgatctgcactaatatggcccagctggtgcccagccacgtgaaaggcctgcacttgaacatggctttggttttragcaacttctctaccctgaccctcctcctgggacagcgtttcgggaggtttcttggcctcactgagagggatgtggagctgctgtaccccgtcaaggaga

SEQ ID NO: 4715 - DNA, 201 bp, Homo sapiens
ctgccgccgccggagcctgcgagccgagaccgtaagcgcccggggccggccgggcccgcactccccggacgcagacgcggttcgggctccgcgcgggctcrgccgccggggtgggcggcgggccggggcgccgaggggtcggggctgcggtcggcccgcaggggtgcagagggacttgtagttggtccgcccccagctcct

SEQ ID NO: 4716 - DNA, 201 bp, Homo sapiens
caggtggagattctcaacagataccctcacttcaagactaagattgaagggctggacatccacttcatccacgtgaagcccccccagctgcccgcaggccrtaccccgaagcccttgctgatggtgcacggctggcccggctctttctacgagttttataagatcatcccactcctgactgaccccaagaaccatggcctg

SEQ ID NO: 4717 - DNA, 201 bp, Homo sapiens
taagcgcccggggccggccgggcccgcactccccggacgcagacgcggttcgggctccgcgcgggctcggccgccggggtgggcggcgggccggggcgccraggggtcggggctgcggtcggcccgcaggggtgcagagggacttgtagttggtccgcccccagctcctgccccggccaggagactgcgcgtgccgcctac

SEQ ID NO: 4718 - DNA, 201 bp, Homo sapiens
ataagttccgtttcaccccacctttggaggacagctgcttccactatggcttcaactccaactacctgaagaaagtcatctcctactggcggaatgaattygactggaagaagcaggtggagattctcaacagataccctcacttcaagactaagattgaagggctggacatccacttcatccacgtgaagcccccccagc

SEQ ID NO: 4719 - DNA, 201 bp, Homo sapiens
actccaactacctgaagaaagtcatctcctactggcggaatgaatttgactggaagaagcaggtggagattctcaacagataccctcacttcaagactaarattgaagggctggacatccacttcatccacgtgaagcccccccagctgcccgcaggccataccccgaagcccttgctgatggtgcacggctggcccggct

SEQ ID NO: 4720 - DNA, 201 bp, Homo sapiens
gaggatggaggcctggaaaggaagttctccctggacgacctgctgaccaacgtcatgctctactggacaacaggcaccatcatctcctcccagcgcttctmcaaggagaacctgggacagggctggatgacccagaagcatgagcggatgaaggtctatgtgcccactggcttctctgccttcccttttgagctattgcac

SEQ ID NO: 4721 - DNA, 201 bp, Homo sapiens
cttctacaaggagaacctgggacagggctggatgacccagaagcatgagcggatgaaggtctatgtgcccactggcttctctgccttcccttttgagctaytgcacacgcctgaaaagtgggtgaggttcaagtacccaaagctcatctcctattcctacatggttcgtgggggccactttgcggcctttgaggagccgga

SEQ ID NO: 4722 - DNA, 201 bp, Homo sapiens
tctctaccctgaccctcctcctgggacagcgtttcgggaggtttcttggcctcactgagagggatgtggagctgctgtaccccgtcaaggagaaggtattytacagcctgatgagggagagcggctacatgcacatccagtgcaccaagcctgacaccgtaggctctgctctgaatgactctcctgtgggtctggctgcct

SEQ ID NO: 4723 - DNA, 201 bp, Homo sapiens
ggccaggcacgaggtccgcagccagggaggacgacagcatccgccctttcaaggtggaaacgtcagatgaggagatccacgacttacaccagaggatcgayaagttccgtttcaccccacctttggaggacagctgcttccactatggcttcaactccaactacctgaagaaagtcatctcctactggcggaatgaatttg

SEQ ID NO: 4724 - DNA, 201 bp, Homo sapiens
ctgcttccactatggcttcaactccaactacctgaagaaagtcatctcctactggcggaatgaatttgactggaagaagcaggtggagattctcaacagayaccctcacttcaagactaagattgaagggctggacatccacttcatccacgtgaagcccccccagctgcccgcaggccataccccgaagcccttgctgat

SEQ ID NO: 4725 - DNA, 201 bp, Homo sapiens
ctttggttttaagcaacttctctaccctgaccctcctcctgggacagcgtttcgggaggtttcttggcctcactgagagggatgtggagctgctgtacccygtcaaggagaaggtattctacagcctgatgagggagagcggctacatgcacatccagtgcaccaagcctgacaccgtaggctctgctctgaatgactctc

SEQ ID NO: 4726 - DNA, 201 bp, Homo sapiens
atattctagagaagttttccacctggaccaatacggaattccgatacctggaggatggaggcctggaaaggaagttctccctggacgacctgctgaccaaygtcatgctctactggacaacaggcaccatcatctcctcccagcgcttctacaaggagaacctgggacagggctggatgacccagaagcatgagcggatga

SEQ ID NO: 4727 - DNA, 201 bp, Homo sapiens
caccagaggatcgataagttccgtttcaccccacctttggaggacagctgcttccactatggcttcaactccaactacctgaagaaagtcatctcctactrgcggaatgaatttgactggaagaagcaggtggagattctcaacagataccctcacttcaagactaagattgaagggctggacatccacttcatccacgtg

SEQ ID NO: 4728 - DNA, 201 bp, Homo sapiens
atctcctattcctacatggttcgtgggggccactttgcggcctttgaggagccggagctgctcgcccaggacatccgcaagttcctgtcggtgctggagcrgcaatgacccacccctctccccccgcctgccacctccccccacaagtgccctccaggcttttcttggggaagataccccttttctgaggaatgagtttgc

SEQ ID NO: 4729 - DNA, 201 bp, Homo sapiens
gtgctgggctttgccatctactggttcatctcccgggacaaagaggaaactttgccacttgaagatgggtggtgggggccaggcacgaggtccgcagccasggaggacgacagcatccgccctttcaaggtggaaacgtcagatgaggagatccacgacttacaccagaggatcgataagttccgtttcaccccacctttg

SEQ ID NO: 4730 - DNA, 201 bp, Homo sapiens
ggctgggcttccaggaattctacattcaaggaggggactgggggtccctgatctgcactaatatggcccagctggtgcccagccacgtgaaaggcctgcayttgaacatggctttggttttaagcaacttctctaccctgaccctcctcctgggacagcgtttcgggaggtttcttggcctcactgagagggatgtggagc

SEQ ID NO: 4731 - DNA, 201 bp, Homo sapiens
tgctgaccaacgtcatgctctactggacaacaggcaccatcatctcctcccagcgcttctacaaggagaacctgggacagggctggatgacccagaagcawgagcggatgaaggtctatgtgcccactggcttctctgccttcccttttgagctattgcacacgcctgaaaagtgggtgaggttcaagtacccaaagctca

SEQ ID NO: 4732 - DNA, 201 bp, Homo sapiens
cacttcagtgctgggctttgccatctactggttcatctcccgggacaaagaggaaactttgccacttgaagatgggtggtgggggccaggcacgaggtccrcagccagggaggacgacagcatccgccctttcaaggtggaaacgtcagatgaggagatccacgacttacaccagaggatcgataagttccgtttcacccc

SEQ ID NO: 4733 - DNA, 201 bp, Homo sapiens
tgacccagaagcatgagcggatgaaggtctatgtgcccactggcttctctgccttcccttttgagctattgcacacgcctgaaaagtgggtgaggttcaartacccaaagctcatctcctattcctacatggttcgtgggggccactttgcggcctttgaggagccggagctgctcgcccaggacatccgcaagttcctgt

SEQ ID NO: 4734 - DNA, 201 bp, Homo sapiens
acccaaagctcatctcctattcctacatggttcgtgggggccactttgcggcctttgaggagccggagctgctcgcccaggacatccgcaagttcctgtcsgtgctggagcggcaatgacccacccctctccccccgcctgccacctccccccacaagtgccctccaggcttttcttggggaagataccccttttctgagg

SEQ ID NO: 4735 - DNA, 201 bp, Homo sapiens
tttgaggagccggagctgctcgcccaggacatccgcaagttcctgtcggtgctggagcggcaatgacccacccctctccccccgcctgccacctccccccmcaagtgccctccaggcttttcttggggaagataccccttttctgaggaatgagtttgcctccgtcccctgcccatgctgggagcccacgctcaccccctc

SEQ ID NO: 4736 - DNA, 201 bp, Homo sapiens
gggatgaggccactggccagggctatgctgcaccagaccaatggcaccgcccccacccctcccagcgcaggggcagcttggagcagaggcagcactggccrccactgcgggggcaagtcagcgtcaagagagtccctgagtgagaaggcccagataagcccaggccccccaggccagcggacaggcacaggcagggcctac

SEQ ID NO: 4737 - DNA, 201 bp, Homo sapiens
atgaggccactggccagggctatgctgcaccagaccaatggcaccgcccccacccctcccagcgcaggggcagcttggagcagaggcagcactggccaccrctgcgggggcaagtcagcgtcaagagagtccctgagtgagaaggcccagataagcccaggccccccaggccagcggacaggcacaggcagggcctacaga

SEQ ID NO: 4738 - DNA, 201 bp, Homo sapiens
gccagcggacaggcacaggcagggcctacagaggtgccaaggccccaggccagttgtgctaggagcctggacctgctcttccacacccccatcccgccccwactgcacaggcttgtgccttggtgccccctggaggcagcagggaggaggcttctcaggcagaagtcttaagttgcatcccattccccagaatccccagga

SEQ ID NO: 4739 - DNA, 201 bp, Homo sapiens
cttctcaggcagaagtcttaagttgcatcccattccccagaatccccaggagggagaagagggatgggctgcccctccttcctgccagagccacagctcamgggcagtgggatggccctgcacccagcccaggtaccccttcctctgtgccgaccatgctgtcctttggctccgaggaggccctgagcactgcccaccccc

SEQ ID NO: 4740 - DNA, 201 bp, Homo sapiens; identical to SEQ ID NO: 4713

SEQ ID NO: 4741 - DNA, 201 bp, Homo sapiens; identical to SEQ ID NO: 4714

SEQ ID NO: 4742 - DNA, 201 bp, Homo sapiens; identical to SEQ ID NO: 4716

SEQ ID NO: 4743 - DNA, 201 bp, Homo sapiens; identical to SEQ ID NO: 4718

SEQ ID NO: 4744 - DNA, 201 bp, Homo sapiens; identical to SEQ ID NO: 4719

SEQ ID NO: 4745 - DNA, 201 bp, Homo sapiens; identical to SEQ ID NO: 4720

SEQ ID NO: 4746 - DNA, 201 bp, Homo sapiens; identical to SEQ ID NO: 4721

SEQ ID NO: 4747 - DNA, 201 bp, Homo sapiens; identical to SEQ ID NO: 4722

SEQ ID NO: 4748 - DNA, 201 bp, Homo sapiens; identical to SEQ ID NO: 4723

SEQ ID NO: 4749 - DNA, 201 bp, Homo sapiens; identical to SEQ ID NO: 4724

SEQ ID NO: 4750 - DNA, 201 bp, Homo sapiens; identical to SEQ ID NO: 4725

SEQ ID NO: 4751 - DNA, 201 bp, Homo sapiens; identical to SEQ ID NO: 4726

SEQ ID NO: 4752 - DNA, 201 bp, Homo sapiens; identical to SEQ ID NO: 4727

SEQ ID NO: 4753 - DNA, 201 bp, Homo sapiens; identical to SEQ ID NO: 4728

SEQ ID NO: 4754 - DNA, 201 bp, Homo sapiens; identical to SEQ ID NO: 4729

SEQ ID NO: 4755 - DNA, 201 bp, Homo sapiens; identical to SEQ ID NO: 4730

SEQ ID NO: 4756 - DNA, 201 bp, Homo sapiens; identical to SEQ ID NO: 4731

SEQ ID NO: 4757 - DNA, 201 bp, Homo sapiens; identical to SEQ ID NO: 4732

SEQ ID NO: 4758 - DNA, 201 bp, Homo sapiens; identical to SEQ ID NO: 4733

SEQ ID NO: 4759 - DNA, 201 bp, Homo sapiens; identical to SEQ ID NO: 4734

SEQ ID NO: 4760 - DNA, 201 bp, Homo sapiens; identical to SEQ ID NO: 4735

SEQ ID NO: 4761 - DNA, 201 bp, Homo sapiens; identical to SEQ ID NO: 4736

SEQ ID NO: 4762 - DNA, 201 bp, Homo sapiens; identical to SEQ ID NO: 4737

SEQ ID NO: 4763 - DNA, 201 bp, Homo sapiens; identical to SEQ ID NO: 4738

SEQ ID NO: 4764 - DNA, 201 bp, Homo sapiens; identical to SEQ ID NO: 4739

SEQ ID NO: 4765 - DNA, 201 bp, Homo sapiens; identical to SEQ ID NO: 4713

SEQ ID NO: 4766 - DNA, 201 bp, Homo sapiens; identical to SEQ ID NO: 4714

SEQ ID NO: 4767 - DNA, 201 bp, Homo sapiens
tgcctgcagcctgccctgcctctctcacaggcccttagagcatcgccaggtgcagagctccacagctctctttcccaaggagtaatcagagggtgagaacrtggagcctggtggacaggtgaaagcactgggatctttctgcccagaaaggggaaagttgcacatttatatcctagagggaagcgacagcagtgcttctcc

SEQ ID NO: 4768 - DNA, 201 bp, Homo sapiens; identical to SEQ ID NO: 4716

SEQ ID NO: 4769 - DNA, 201 bp, Homo sapiens; identical to SEQ ID NO: 4718

SEQ ID NO: 4770 - DNA, 201 bp, Homo sapiens; identical to SEQ ID NO: 4719

SEQ ID NO: 4771 - DNA, 201 bp, Homo sapiens; identical to SEQ ID NO: 4720

SEQ ID NO: 4772 - DNA, 201 bp, Homo sapiens; identical to SEQ ID NO: 4721

SEQ ID NO: 4773 - DNA, 201 bp, Homo sapiens; identical to SEQ ID NO: 4722

SEQ ID NO: 4774 - DNA, 201 bp, Homo sapiens; identical to SEQ ID NO: 4723

SEQ ID NO: 4775 - DNA, 201 bp, Homo sapiens; identical to SEQ ID NO: 4724

SEQ ID NO: 4776 - DNA, 201 bp, Homo sapiens; identical to SEQ ID NO: 4725

SEQ ID NO: 4777 - DNA, 201 bp, Homo sapiens; identical to SEQ ID NO: 4726

SEQ ID NO: 4778 - DNA, 201 bp, Homo sapiens; identical to SEQ ID NO: 4727

SEQ ID NO: 4779 - DNA, 201 bp, Homo sapiens; identical to SEQ ID NO: 4728

SEQ ID NO: 4780 - DNA, 162 bp, Homo sapiens
ctgacttggcaggactgtgcaattgtcagaaggccgtggggagtgggggccagtgcctgcakcctgccctgcctctctcacaggcccttagagcatcgccaggtgcagagctccacagctctctttcccaaggagtaatcagagggtgagaacgtggagcct

SEQ ID NO: 4781 - DNA, 166 bp, Homo sapiens
ctgacttggcaggactgtgcaattgtcagaaggccgtggggagtgggggccagtgcctgcagcctrccctgcctctctcacaggcccttagagcatcgccaggtgcagagctccacagctctctttcccaaggagtaatcagagggtgagaacgtggagcctggtg

SEQ ID NO: 4782 - DNA, 201 bp, Homo sapiens; identical to SEQ ID NO: 4729

SEQ ID NO: 4783 - DNA, 201 bp, Homo sapiens; identical to SEQ ID NO: 4730

SEQ ID NO: 4784 - DNA, 201 bp, Homo sapiens; identical to SEQ ID NO: 4731

SEQ ID NO: 4785 - DNA, 201 bp, Homo sapiens; identical to SEQ ID NO: 4732

SEQ ID NO: 4786 - DNA, 201 bp, Homo sapiens; identical to SEQ ID NO: 4733

SEQ ID NO: 4787 - DNA, 201 bp, Homo sapiens; identical to SEQ ID NO: 4734

SEQ ID NO: 4788 - DNA, 201 bp, Homo sapiens; identical to SEQ ID NO: 4735

SEQ ID NO: 4789 - DNA, 201 bp, Homo sapiens; identical to SEQ ID NO: 4736

SEQ ID NO: 4790 - DNA, 201 bp, Homo sapiens; identical to SEQ ID NO: 4737

SEQ ID NO: 4791 - DNA, 201 bp, Homo sapiens; identical to SEQ ID NO: 4738

SEQ ID NO: 4792 - DNA, 201 bp, Homo sapiens; identical to SEQ ID NO: 4739

SEQ ID NO: 4793 - DNA, 201 bp, Homo sapiens; identical to SEQ ID NO: 4713

SEQ ID NO: 4794 - DNA, 201 bp, Homo sapiens; identical to SEQ ID NO: 4714

SEQ ID NO: 4795 - DNA, 201 bp, Homo sapiens; identical to SEQ ID NO: 4716

SEQ ID NO: 4796 - DNA, 201 bp, Homo sapiens; identical to SEQ ID NO: 4718

SEQ ID NO: 4797 - DNA, 201 bp, Homo sapiens; identical to SEQ ID NO: 4719

SEQ ID NO: 4798 - DNA, 201 bp, Homo sapiens; identical to SEQ ID NO: 4720

SEQ ID NO: 4799 - DNA, 201 bp, Homo sapiens; identical to SEQ ID NO: 4721

SEQ ID NO: 4800 - DNA, 201 bp, Homo sapiens; identical to SEQ ID NO: 4722

SEQ ID NO: 4801 - DNA, 201 bp, Homo sapiens; identical to SEQ ID NO: 4723

SEQ ID NO: 4802 - DNA, 201 bp, Homo sapiens; identical to SEQ ID NO: 4724

SEQ ID NO: 4803 - DNA, 201 bp, Homo sapiens; identical to SEQ ID NO: 4725

SEQ ID NO: 4804 - DNA, 201 bp, Homo sapiens; identical to SEQ ID NO: 4726

SEQ ID NO: 4805 - DNA, 201 bp, Homo sapiens; identical to SEQ ID NO: 4727

SEQ ID NO: 4806 - DNA, 201 bp, Homo sapiens; identical to SEQ ID NO: 4728

SEQ ID NO: 4807 - DNA, 201 bp, Homo sapiens; identical to SEQ ID NO: 4729

SEQ ID NO: 4808 - DNA, 201 bp, Homo sapiens; identical to SEQ ID NO: 4730

SEQ ID NO: 4809 - DNA, 201 bp, Homo sapiens; identical to SEQ ID NO: 4731

SEQ ID NO: 4810 - DNA, 201 bp, Homo sapiens; identical to SEQ ID NO: 4732

SEQ ID NO: 4811 - DNA, 201 bp, Homo sapiens; identical to SEQ ID NO: 4733

SEQ ID NO: 4812 - DNA, 201 bp, Homo sapiens; identical to SEQ ID NO: 4734

SEQ ID NO: 4813 - DNA, 201 bp, Homo sapiens; identical to SEQ ID NO: 4735

SEQ ID NO: 4814 - DNA, 124 bp, Homo sapiens
gggatgaggccactggccagggctatgctgcaccagaccaatggcaccgcccccacccctcccagcgcaggggcagcttggagcagaggcagcactggccrccactgcgggggcaagtcagcgt

SEQ ID NO: 4815 - DNA, 121 bp, Homo sapiens
atgaggccactggccagggctatgctgcaccagaccaatggcaccgcccccacccctcccagcgcaggggcagcttggagcagaggcagcactggccaccrctgcgggggcaagtcagcgt

SEQ ID NO: 4816 - DNA, 201 bp, Homo sapiens
gatgcgccgatcgtggcccacctttgggagtacgtcatgtccattgacagcctccagctgggctatgcggaggatgggcactgcaaaggcgacatcaatcygaacattccgtaccccaccaggctgcagtgggacatcccgggggaatgtcaagaggttatagagacctccctgaacaccgcaaatcttctggcaaacgac

SEQ ID NO: 4817 - DNA, 201 bp, Homo sapiens
gaacaccgcaaatcttctggcaaacgacgtggatttccattccttcccattcgtagcctttggtaaaggaatcatcaagaaatgtcgcacgagcccagacrcctttgtgcagctggccctccagctggcgcactacaaggacatgggcaagttttgcctcacatacgaggcctccatgacccggctcttccgagaggggag

SEQ ID NO: 4818 - DNA, 201 bp, Homo sapiens
gttttatctgagccttggagattatcaacaagccagacccctcagcagcaagtggagctgtttgacttggagaataacccagagtacgtgtccagcggagrgggctttggaccggttgctgatgacggctatggtgtgtcgtacatccttgtgggagagaacctcatcaatttccacatttcttccaagttctcttgccct

SEQ ID NO: 4819 - DNA, 201 bp, Homo sapiens
caccatccagcacatgagagacagcaagcacatcgtcgtgtaccatcgaggacgctacttcaaggtctggctctaccatgatgggcggctgctgaagcccygggagatggagcagcagatgcagaggatcctggacaatacctcggagcctcagcccggggaggccaggctggcagccctcaccgcaggagacagagttcc

SEQ ID NO: 4820 - DNA, 201 bp, Homo sapiens
gactctggaaacggccaactgcatgtccagccagacgaagaacgtggtcagcggcgtgctgtttggcaccggcctgtgggtggccctcatcgtcaccatgygctactccctgaaagtgctgctctcctaccacgggtggatgttcactgagcacggcaagatgagtcgtgccaccaagatctggatgggtatggtcaagat

SEQ ID NO: 4821 - DNA, 201 bp, Homo sapiens
cctccgaggacgagggccgctcatggtgaacagcaactattatgccatggatctgctgtatatccttccaactcacattcaggcagcaagagccggcaacrccatccatgccatcctgctttacaggcgcaaactggaccgggaggaaatcaaaccaattcgtcttttgggatccacgattccactctgctccgctcagtg

SEQ ID NO: 4822 - DNA, 201 bp, Homo sapiens
agaacggcatcatcactggcgtgtacccggcaagcccctccagttggcttatcgtggtggtgggcgtgatgacaacgatgtacgccaagatcgacccctcrttaggaataattgcaaaaatcaatcggactctggaaacggccaactgcatgtccagccagacgaagaacgtggtcagcggcgtgctgtttggcaccggcc

SEQ ID NO: 4823 - DNA, 201 bp, Homo sapiens
ggtgggcgtgatgacaacgatgtacgccaagatcgacccctcgttaggaataattgcaaaaatcaatcggactctggaaacggccaactgcatgtccagcyagacgaagaacgtggtcagcggcgtgctgtttggcaccggcctgtgggtggccctcatcgtcaccatgcgctactccctgaaagtgctgctctcctacca

SEQ ID NO: 4824 - DNA, 201 bp, Homo sapiens
gggaggaaatcaaaccaattcgtcttttgggatccacgattccactctgctccgctcagtgggagcggatgtttaatacttcccggatcccaggagaggaracagacaccatccagcacatgagagacagcaagcacatcgtcgtgtaccatcgaggacgctacttcaaggtctggctctaccatgatgggcggctgctga

SEQ ID NO: 4825 - DNA, 201 bp, Homo sapiens
tggcgtctgagaagcatcagcatatgtatcgcctcgccatgaccggctctgggatcgatcgtcacctcttctgcctttacgtggtgtctaaatatctcgcygtggagtcccctttccttaaggaagttttatctgagccttggagattatcaacaagccagacccctcagcagcaagtggagctgtttgacttggagaata

SEQ ID NO: 4826 - DNA, 201 bp, Homo sapiens
cctcgttaggaataattgcaaaaatcaatcggactctggaaacggccaactgcatgtccagccagacgaagaacgtggtcagcggcgtgctgtttggcacyggcctgtgggtggccctcatcgtcaccatgcgctactccctgaaagtgctgctctcctaccacgggtggatgttcactgagcacggcaagatgagtcgtg

SEQ ID NO: 4827 - DNA, 201 bp, Homo sapiens
ccgcaggagacagagttccctgggccaggtgtcgtcaggcctattttggacgtgggaaaaataagcagtctcttgatgctgtggagaaagcagcgttcttygtgacgttagatgaaactgaagaaggatacagaagtgaagacccggatacgtcaatggacagctacgccaaatctctactacacggccgatgttacgaca

SEQ ID NO: 4828 - DNA, 201 bp, Homo sapiens
gaatcatcaagaaatgtcgcacgagcccagacgcctttgtgcagctggccctccagctggcgcactacaaggacatgggcaagttttgcctcacatacgargcctccatgacccggctcttccgagaggggaggacggagaccgtgcgctcctgcaccactgagtcatgcgacttcgtgcgggccatggtggacccggccc

SEQ ID NO: 4829 - DNA, 201 bp, Homo sapiens
ggcgtgatgacaacgatgtacgccaagatcgacccctcgttaggaataattgcaaaaatcaatcggactctggaaacggccaactgcatgtccagccagaygaagaacgtggtcagcggcgtgctgtttggcaccggcctgtgggtggccctcatcgtcaccatgcgctactccctgaaagtgctgctctcctaccacggg

SEQ ID NO: 4830 - DNA, 201 bp, Homo sapiens
gcagccctcaccgcaggagacagagttccctgggccaggtgtcgtcaggcctattttggacgtgggaaaaataagcagtctcttgatgctgtggagaaagyagcgttcttcgtgacgttagatgaaactgaagaaggatacagaagtgaagacccggatacgtcaatggacagctacgccaaatctctactacacggccga

SEQ ID NO: 4831 - DNA, 201 bp, Homo sapiens
gaagttttatctgagccttggagattatcaacaagccagacccctcagcagcaagtggagctgtttgacttggagaataacccagagtacgtgtccagcgragggggctttggaccggttgctgatgacggctatggtgtgtcgtacatccttgtgggagagaacctcatcaatttccacatttcttccaagttctcttgc

SEQ ID NO: 4832 - DNA, 201 bp, Homo sapiens; identical to SEQ ID NO: 4816

SEQ ID NO: 4833 - DNA, 201 bp, Homo sapiens; identical to SEQ ID NO: 4817

SEQ ID NO: 4834 - DNA, 201 bp, Homo sapiens; identical to SEQ ID NO: 4818

SEQ ID NO: 4835 - DNA, 201 bp, Homo sapiens; identical to SEQ ID NO: 4819

SEQ ID NO: 4836 - DNA, 201 bp, Homo sapiens; identical to SEQ ID NO: 4820

SEQ ID NO: 4837 - DNA, 201 bp, Homo sapiens; identical to SEQ ID NO: 4821

SEQ ID NO: 4838 - DNA, 201 bp, Homo sapiens; identical to SEQ ID NO: 4822

SEQ ID NO: 4839 - DNA, 201 bp, Homo sapiens; identical to SEQ ID NO: 4823

SEQ ID NO: 4840 - DNA, 201 bp, Homo sapiens; identical to SEQ ID NO: 4824

SEQ ID NO: 4841 - DNA, 201 bp, Homo sapiens; identical to SEQ ID NO: 4825

SEQ ID NO: 4842 - DNA, 201 bp, Homo sapiens; identical to SEQ ID NO: 4826

SEQ ID NO: 4843 - DNA, 201 bp, Homo sapiens; identical to SEQ ID NO: 4827

SEQ ID NO: 4844 - DNA, 201 bp, Homo sapiens; identical to SEQ ID NO: 4828

SEQ ID NO: 4845 - DNA, 201 bp, Homo sapiens; identical to SEQ ID NO: 4829

SEQ ID NO: 4846 - DNA, 201 bp, Homo sapiens; identical to SEQ ID NO: 4830

SEQ ID NO: 4847 - DNA, 201 bp, Homo sapiens; identical to SEQ ID NO: 4831

SEQ ID NO: 4848 - DNA, 201 bp, Homo sapiens
caggaaggaaggggtatagagaaaatatgagtctcaccacactagaagcaacatatgcaaaatccatcaaacacaccataaaatcaatgtgggagtaacamcaccttggcctactgctccctgaaaagtttttctctcgtcaagtgatgacaggcgtacatttgtaaataaattaccaagttgcttttgatttgatggaga

SEQ ID NO: 4849 - DNA, 201 bp, Homo sapiens
cttgatccaggaaggaaggggtatagagaaaatatgagtctcaccacactagaagcaacatatgcaaaatccatcaaacacaccataaaatcaatgtgggwgtaacaacaccttggcctactgctccctgaaaagtttttctctcgtcaagtgatgacaggcgtacatttgtaaataaattaccaagttgcttttgatttg

SEQ ID NO: 4850 - DNA, 201 bp, Homo sapiens
tccaggaaggaaggggtatagagaaaatatgagtctcaccacactagaagcaacatatgcaaaatccatcaaacacaccataaaatcaatgtgggagtaayaacaccttggcctactgctccctgaaaagtttttctctcgtcaagtgatgacaggcgtacatttgtaaataaattaccaagttgcttttgatttgatgga

SEQ ID NO: 4851 - DNA, 201 bp, Homo sapiens
cacactagaagcaacatatgcaaaatccatcaaacacaccataaaatcaatgtgggagtaacaacaccttggcctactgctccctgaaaagtttttctctmgtcaagtgatgacaggcgtacatttgtaaataaattaccaagttgcttttgatttgatggagaaggaagaaaaggattgtctcctggaagtatttttatt

SEQ ID NO: 4852 - DNA, 201 bp, Homo sapiens
ctctgttcagcaaactgagatcttttgagaatcttaacaaatgtatacccctccctctcaccttttcctctctggtgtatttcataggcagctttgctaamtgactgcactactacaaatagattctgtcactttagaaataggatttttccttttataggcagattgatggactaagtgtcaaggttttagaacagtagc

SEQ ID NO: 4853 - DNA, 160 bp, Homo sapiens
gattgatggactaagtgtcaaggttttagaacagtagcatgactggggcagacactataaaccataaatccagtattgacaaatgttctagccaatccagrttttctatttgttaaattgcctttatgaagtcatacttgtgcagcacagaatatggaaa

SEQ ID NO: 4854 - DNA, 201 bp, Homo sapiens
gcaaaaaattgaagtgggaagctgctaaagaatgtgcttgactaaaacaaggcaataagcaaaaggaagtcatagcatccagaaaatgggatccatcatgygcacaaagaaaaggtgaagaaaatttccaggatgttcagaacccaccaaaaacgaaagattctggtccagatcagaagagagggaaacactctgaaaaag

SEQ ID NO: 4855 - DNA, 120 bp, Homo sapiens
aacgaaagattctggtccagatcagaagagagggaaacactctgaaaaagtccctcaaatacaaaattaaacagagtttaaatgatgtgcttgaccacaawaaaaggcttcttgctctgt

SEQ ID NO: 4856 - DNA, 201 bp, Homo sapiens
atggctaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccc

SEQ ID NO: 4857 - DNA, 201 bp, Homo sapiens
tttccctccccaaccctcccccaagctaaaattctcttcccaggagccctgtcatcagcagggagttttctgtctttgtccccatctcttcacttgtgctstgcaaaatcaggccacgattgcagggtagtccacggcttccaaagagaactgcataaatatacatctttcaggggaagagggagaacctggagaagtcag

SEQ ID NO: 4858 - DNA, 201 bp, Homo sapiens
caggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccac

SEQ ID NO: 4859 - DNA, 119 bp, Homo sapiens
gtacaatccaagtctgtcrctgcccaggatagaggagggatgacgtgaattcacacgggcctctcctacaaatctgagtgtacatcaagtgaggggcgtccctccgcacctcactgttg

SEQ ID NO: 4860 - DNA, 201 bp, Homo sapiens
gaaagaaatgtaaatcaagtgactgttgatggacgcttggaagaattcttatttatttatttttttggacaggctttcactctgtcagccaggctggagtkcaagtggcccaatcatggcttactgcagactcaacctcctgggtgcaagtaatcctcccacctcagcctcctgtgtagtggagaccataggcatgttcca

SEQ ID NO: 4861 - DNA, 201 bp, Homo sapiens
ttcccccgtgactgctgcgggggcctaggccaaagatatgcccgagtagaaaatctgacaccagcttcccagttttctcttctgctctctttggctgcaasgcttttaccatggctaaaccattaggccggctctgcagggagggcaagaccacagcagctcagtatttcctgctcagggaaaaaggccaggtcttttgtt

SEQ ID NO: 4862 - DNA, 201 bp, Homo sapiens
ctgcgggggcctaggccaaagatatgcccgagtagaaaatctgacaccagcttcccagttttctcttctgctctctttggctgcaacgcttttaccatggstaaaccattaggccggctctgcagggagggcaagaccacagcagctcagtatttcctgctcagggaaaaaggccaggtcttttgttggtggaaatccact

SEQ ID NO: 4863 - DNA, 201 bp, Homo sapiens
tgcgggggcctaggccaaagatatgcccgagtagaaaatctgacaccagcttcccagttttctcttctgctctctttggctgcaacgcttttaccatggcyaaaccattaggccggctctgcagggagggcaagaccacagcagctcagtatttcctgctcagggaaaaaggccaggtcttttgttggtggaaatccactt

SEQ ID NO: 4864 - DNA, 201 bp, Homo sapiens
tactttctaaaattctcgggcctttgcaccttctttttatcaacgcttagttctatgttactgaatatttcttaattaagtgcaggaaagaaaataaccaytttttctccttttaaagaagcacacacacctttcttttattggtattacattccttttccctgttggtgcccctgttggttttccaaattgtcttcccat

SEQ ID NO: 4865 - DNA, 201 bp, Homo sapiens
ttataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatgg

SEQ ID NO: 4866 - DNA, 201 bp, Homo sapiens
tctccttttaaagaagcacacacacctttcttttattggtattacattccttttccctgttggtgcccctgttggttttccaaattgtcttcccatccttrtcctacctcccaatagagtacctcatcctatagtgttattataactacagaaaatatattttcattccttccacttcatgctttcagctagaaatgtgag

SEQ ID NO: 4867 - DNA, 201 bp, Homo sapiens
tcctctgccctgtcctcaggcttagccttagtgggcctggtttttgcccccctccagttttagcttcccatctaaaatacaagggaaaagacagcaaggasaggacacttcctcctagtgtcttgtaaagctgcaagggagtcgcggctgagtcgaggatccacattcctggatgagtccttttgttaccagcggagggtg

SEQ ID NO: 4868 - DNA, 201 bp, Homo sapiens
gacagcatctacatccacctctgcaggaagcaagggaaacatttttcttctggagaatcgggcagcctgcagctgatccggtggtgtctgaaaccatcctktgtgctgtagtgtcaacaacttagcctggttactttgccaccaaaccccaccaaatgcctttgtatctttttcagaactgcatctctgcagcataattga

SEQ ID NO: 4869 - DNA, 201 bp, Homo sapiens
ttattgaaagcaaaactacactccatagagtgggaacggcccaagcagccactcaggggccctggatagagaatcttctggagtctaaatactccctagakgtttcccattggccacttggggtacaccccttataaatgaagtggtggcctgcaatcagtcttattggttgcagaaagcaaccaatcagaggctgaagtg

SEQ ID NO: 4870 - DNA, 201 bp, Homo sapiens
agtgaccacataatttatcatccacactggcacctttttgagagaggatggggagcaggtaattatgctgggacaataggcgtatgtcaagatatctggtyaccctatctatgatctgtcacacttagtactttctaaaattctcgggcctttgcaccttctttttatcaacgcttagttctatgttactgaatatttctt

SEQ ID NO: 4871 - DNA, 201 bp, Homo sapiens
taattttttattttttgtagaaatggggtctcaccatattgaccaggccggactcaaactccgagatgcacgtgaatctccagctgtggccccttccaaartgctgggattagatgcatgagccacctggcccagccagaatccttccattaataaaaggatggaccatgaactcccttttatgatatgagccgatcaaat

SEQ ID NO: 4872 - DNA, 201 bp, Homo sapiens
gcatagcccaaggcagcttgagaggaaagcctcttggccttgaataagatgactttgttactgggcaaagaaagcccggctggaagtgctctttgatatgsaaatatagcctgataaggatttcctctccttcctactttccctccccaaccctcccccaagctaaaattctcttcccaggagccctgtcatcagcaggga

SEQ ID NO: 4873 - DNA, 201 bp, Homo sapiens
ccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctgg

SEQ ID NO: 4874 - DNA, 201 bp, Homo sapiens
cgtccctccgcacctcactgttgggctgatcaatcccattcccactccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagac

SEQ ID NO: 4875 - DNA, 201 bp, Homo sapiens
gcatgagccacctggcccagccagaatccttccattaataaaaggatggaccatgaactcccttttatgatatgagccgatcaaatgtgagcagaatagtrtcctatttatacaatgtagtttaaaaccaacttcttagaaccatgagctaagggggaatctggatttcaaatgctagttgcatcaaacacgtttccaccc

SEQ ID NO: 4876 - DNA, 201 bp, Homo sapiens
ctaaatactccctagaggtttcccattggccacttggggtacaccccttataaatgaagtggtggcctgcaatcagtcttattggttgcagaaagcaaccratcagaggctgaagtgaagttacaaatatcacactcctatgcaaacatctgattggttgcaaaaagcaaaaccactcagaggtactttcaatttcccatc

SEQ ID NO: 4877 - DNA, 201 bp, Homo sapiens
aaccctcccttccccaggtcagcctgcctcccaggtgttggtgctatgattacagtgaccacataatttatcatccacactggcacctttttgagagaggwtggggagcaggtaattatgctgggacaataggcgtatgtcaagatatctggtcaccctatctatgatctgtcacacttagtactttctaaaattctcggg

SEQ ID NO: 4878 - DNA, 201 bp, Homo sapiens
gaatatttcttaattaagtgcaggaaagaaaataaccattttttctccttttaaagaagcacacacacctttcttttattggtattacattccttttcccwgttggtgcccctgttggttttccaaattgtcttcccatccttgtcctacctcccaatagagtacctcatcctatagtgttattataactacagaaaatat

SEQ ID NO: 4879 - DNA, 201 bp, Homo sapiens
aaagcaaaaccactcagaggtactttcaatttcccatctgccctgcagaaaaggtaaggggttgcaaaagagtagcccctcctccttttgttacttaggcrtggaaagttaagggtttcctttcagtttggttctaagaagtcagagtgaaatggctttagattccctgcctgcagattctattccccagcctcactttga

SEQ ID NO: 4880 - DNA, 201 bp, Homo sapiens
atagagaatcttctggagtctaaatactccctagaggtttcccattggccacttggggtacaccccttataaatgaagtggtggcctgcaatcagtcttaytggttgcagaaagcaaccaatcagaggctgaagtgaagttacaaatatcacactcctatgcaaacatctgattggttgcaaaaagcaaaaccactcagag

SEQ ID NO: 4881 - DNA, 201 bp, Homo sapiens
tccattaataaaaggatggaccatgaactcccttttatgatatgagccgatcaaatgtgagcagaatagtatcctatttatacaatgtagtttaaaaccarcttcttagaaccatgagctaagggggaatctggatttcaaatgctagttgcatcaaacacgtttccaccccctcaaaacgtggcccaaagtcattagtgt

SEQ ID NO: 4882 - DNA, 201 bp, Homo sapiens
aactacagaaaatatattttcattccttccacttcatgctttcagctagaaatgtgagtctctgagacttgtattcttggggtcacttaaaacatactgcrtaatgaggccttcaatgactctgatttggaactgaccctctatgaggggttatacccctggacaccaagctgctggcctgagcatgaggttgatggccaa

SEQ ID NO: 4883 - DNA, 201 bp, Homo sapiens
tgtgtagtaaatggctgcagccctataagctataatcatatatcatcaacacctttaccctgttattaacgtgtctgaaattagggaacaccacgtacaasagggatcagggtccacctttctgaagaaaactgcagagcttttgcagttattaaactagcaacagatgtaaagtccaactgttagagtttttctttaaag

SEQ ID NO: 4884 - DNA, 201 bp, Homo sapiens
tcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctg

SEQ ID NO: 4885 - DNA, 201 bp, Homo sapiens
atgacgtgaattcacacgggcctctcctacaaatctgagtgtacatcaagtgaggggcgtccctccgcacctcactgttgggctgatcaatcccattcccmctccattatgtgtgtatttctaagtggcagatttgccttaggaaatggaagaaggggatgaaatagtgaccaacacaaattactgggttggcgggagttg

SEQ ID NO: 4886 - DNA, 201 bp, Homo sapiens
acaataggcgtatgtcaagatatctggtcaccctatctatgatctgtcacacttagtactttctaaaattctcgggcctttgcaccttctttttatcaacrcttagttctatgttactgaatatttcttaattaagtgcaggaaagaaaataaccattttttctccttttaaagaagcacacacacctttcttttattggt

SEQ ID NO: 4887 - DNA, 201 bp, Homo sapiens
tgttgattaattaaaggacccaagagctaaaagggagaagtagctgcatgcttgccacttagtaatattttgataagtatttttgggatgaatgcaatgaygcatgaatgaatgaatgaatgaataacataggctacagtattttgtcttcttggttagggaccttgagtaaactgaggagtctgaggggaatgccatgga

SEQ ID NO: 4888 - DNA, 201 bp, Homo sapiens
ttgattaattaaaggacccaagagctaaaagggagaagtagctgcatgcttgccacttagtaatattttgataagtatttttgggatgaatgcaatgacgsatgaatgaatgaatgaatgaataacataggctacagtattttgtcttcttggttagggaccttgagtaaactgaggagtctgaggggaatgccatggaag

SEQ ID NO: 4889 - DNA, 201 bp, Homo sapiens
cttgaaattgtttttgatcatgtgacaaggtcttctgaccctttatcacccacagtgttttattcatttgctctaaaccagcagtaggtgaagttaggaayaatatgtcaagcttcctaactccatggtgctctcattgttgtgtgtgtgtgtctgtgaataaacacggaaataattacgcaaataagctattggcaggtg

SEQ ID NO: 4890 - DNA, 201 bp, Homo sapiens
gccaggagggtttctctgaggagatcccatttcaacagatctagaaatgtaatggagccagtcctagggaaacaggactaccaggaatcctcaccagcccsgcaaagacgagggagcagcaagttccaaagcccgtggcatgtcaagggtcgatgaattcaccaactgcaaggggctttggtgaccccagtgaacagatga

SEQ ID NO: 4891 - DNA, 201 bp, Homo sapiens
acagatctagaaatgtaatggagccagtcctagggaaacaggactaccaggaatcctcaccagccccgcaaagacgagggagcagcaagttccaaagcccrtggcatgtcaagggtcgatgaattcaccaactgcaaggggctttggtgaccccagtgaacagatgagaaaggggaggaggctgggatcagtgcacagctt

SEQ ID NO: 4892 - DNA, 201 bp, Homo sapiens
aggaggctgggatcagtgcacagctttgcaggctttgggaaggaatttcgagtttatctcatttgtccaggtatttggatgaagccctggcatactaaccstatgaaagtttatagttcccaaattgcaggataacaaggctctgtaatcttcatttcctcaaagttttacaccaggattctatggccaagtgtgtggcag

SEQ ID NO: 4893 - DNA, 201 bp, Homo sapiens
agacagggggattgccataaagaaagagtttaggtccaggcacggtggctcatgcctgtaatcccagcattttgggaggccaaggagggtggttcaactgmggtcaggagtttgagaccatcctggccaaggtggtgaaaccccatccctactaaagatactaatattagccaggcgtagtggtaggcgcctgtaatccta

SEQ ID NO: 4894 - DNA, 117 bp, Homo sapiens
agctagtcgggaggcagaggcaggagaactgcttgaacctgggaggcagaggctgcagtgagtcgagatcacaccactgcactccagcctgggcgacagastgaaactctgtctcgg

SEQ ID NO: 4895 - DNA, 201 bp, Homo sapiens
ttcagtgacatgccatcagatttgttccatgtagaaggacgacactatcagttagatgcttattttgttggcaaatttctatggcacttctgcttggctayttcaaaccaaccatggaagaatagataccccaatgcgatgtttcatccctattcataaagaaactgtactttgagcaatgtaggtatcccaggcagcatc

SEQ ID NO: 4896 - DNA, 201 bp, Homo sapiens
tctattgtttctcattacccatcgaccactgtgaagagatctctctgtgtaaaggcagtgcctaagctatcaccattaattatggaagtaatataaatgasacactctccacagtatgttctaaatgaaatattaacaaggccagcgtcttggaacctgagaaatggtctgttccagtgagctctgtatggaaatccacac

SEQ ID NO: 4897 - DNA, 201 bp, Homo sapiens
tgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaa

SEQ ID NO: 4898 - DNA, 175 bp, Homo sapiens
ctaggaagaaatctttaatttctattcagctttaaagagtttgagagcgttttttcccctctgttaacaaacgasttcaagtacatgccttcatattataaaagtacctgaaattgcctagaatagcagcatgcataaatgcaaactttgaaaaagacatacctttgtaactttc

SEQ ID NO: 4899 - DNA, 201 bp, Homo sapiens
attctggaacacgaaggaggtatgaaaagggcttcactcgtttcatggaaaagctcagaacagtttgtcgacttggaaacacaggccctgacagcgtaccmaggtcaccctgcccttcaatcctgctgatagcccaagttaacatcctcccatgccttggccttcccagaacaaacatggctttggacgcctttgggtggt

SEQ ID NO: 4900 - DNA, 148 bp, Homo sapiens
ctaggaagaaatctttaatttctattcagctttaaagagtttgagagmgttttttcccctctgttaacaaacgagttcaagtacatgccttcatattataaaagtacctgaaattgcctagaatagcagcatgcataaatgcaaactt

SEQ ID NO: 4901 - DNA, 201 bp, Homo sapiens
agcatgcataaatgcaaactttgaaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaa

SEQ ID NO: 4902 - DNA, 201 bp, Homo sapiens
ttttttttttttttttcttcagtgctttttcaggactatgttatagaatacttatggggcatacgtgtaaatgaactgtcaaccttaaaatctaaacaaamagcttgtttgtggttcgtcctgaaatcctccctgctcacaaaacagccagctacttggttttctaaaagacgtaattttgcaggcagacttcgtagagcc

SEQ ID NO: 4903 - DNA, 201 bp, Homo sapiens
gcaagaattctggaacacgaaggaggtatgaaaagggcttcactcgtttcatggaaaagctcagaacagtttgtcgacttggaaacacaggccctgacagygtaccaaggtcaccctgcccttcaatcctgctgatagcccaagttaacatcctcccatgccttggccttcccagaacaaacatggctttggacgcctttg

SEQ ID NO: 4904 - DNA, 201 bp, Homo sapiens
ttcgtcctgaaatcctccctgctcacaaaacagccagctacttggttttctaaaagacgtaattttgcaggcagacttcgtagagccattctgtgcagaasaagggaagggagaagctgtttgttttacctgtagtatgaagatattctttgcgctgttagaactgagctcattaattctgcctggcaataatttcaaagg

SEQ ID NO: 4905 - DNA, 201 bp, Homo sapiens
ttttttcccctctgttaacaaacgagttcaagtacatgccttcatattataaaagtacctgaaattgcctagaatagcagcatgcataaatgcaaactttraaaaagacatacctttgtaactttctatgctaaggtgttgcataatcaaggttaatttttgtttgtttctagtctatgggcatcaagtgctttaaaatgc

SEQ ID NO: 4906 - DNA, 201 bp, Homo sapiens
taaaaatgtaaaatgtttcaaataaacacacactaaatatcttcttttatatcttataaacacccagcagtcctttagcacgggcatcaaggtggcccagytggaaaatttcagtgacatgccatcagatttgttccatgtagaaggacgacactatcagttagatgcttattttgttggcaaatttctatggcacttctg

SEQ ID NO: 4907 - DNA, 201 bp, Homo sapiens
atttcagtgacatgccatcagatttgttccatgtagaaggacgacactatcagttagatgcttattttgttggcaaatttctatggcacttctgcttggcyatttcaaaccaaccatggaagaatagataccccaatgcgatgtttcatccctattcataaagaaactgtactttgagcaatgtaggtatcccaggcagca

SEQ ID NO: 4908 - DNA, 201 bp, Homo sapiens
atggcaagaattctggaacacgaaggaggtatgaaaagggcttcactcgtttcatggaaaagctcagaacagtttgtcgacttggaaacacaggccctgasagcgtaccaaggtcaccctgcccttcaatcctgctgatagcccaagttaacatcctcccatgccttggccttcccagaacaaacatggctttggacgcct

SEQ ID NO: 4909 - DNA, 201 bp, Homo sapiens
gttaaagaagtagagtaaaaatgtaaaatgtttcaaataaacacacactaaatatcttcttttatatcttataaacacccagcagtcctttagcacgggcrtcaaggtggcccagttggaaaatttcagtgacatgccatcagatttgttccatgtagaaggacgacactatcagttagatgcttattttgttggcaaatt

SEQ ID NO: 4910 - DNA, 201 bp, Homo sapiens
gcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataa

SEQ ID NO: 4911 - DNA, 201 bp, Homo sapiens
ctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaaga

SEQ ID NO: 4912 - DNA, 201 bp, Homo sapiens
aagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaacagcttgtttgtggtt

SEQ ID NO: 4913 - DNA, 201 bp, Homo sapiens
cttcagtgctttttcaggactatgttatagaatacttatggggcatacgtgtaaatgaactgtcaaccttaaaatctaaacaaacagcttgtttgtggttygtcctgaaatcctccctgctcacaaaacagccagctacttggttttctaaaagacgtaattttgcaggcagacttcgtagagccattctgtgcagaagaa

SEQ ID NO: 4914 - DNA, 201 bp, Homo sapiens
aaacaaacagcttgtttgtggttcgtcctgaaatcctccctgctcacaaaacagccagctacttggttttctaaaagacgtaattttgcaggcagacttcrtagagccattctgtgcagaagaagggaagggagaagctgtttgttttacctgtagtatgaagatattctttgcgctgttagaactgagctcattaattct

SEQ ID NO: 4915 - DNA, 145 bp, Homo sapiens
taagttttaggaaagaattctttccagctttccatcctgaacctgctggtctccaggctcgttcctgcaaatatttcacagaggagtaagagccacattcktgctggctttccaattcattctcctctcttcgagtccacctctt

SEQ ID NO: 4916 - DNA, 131 bp, Homo sapiens
gaattctttccagctttccatcctgaacctgctggtctccaggctcgttcctgcaaatatttcacagaggagtaagagccacattcttgctggctttccarttcattctcctctcttcgagtccacctctt

SEQ ID NO: 4917 - DNA, 201 bp, Homo sapiens
gctacataaagcaagagatttggataaagaaatggcagtggcaaggagggcaaatggatttctgctgtatttagaatgccacggtaaaaactttgtatttrttaggtatggagaatgagagggaagtgaaggctgatccccagtttctggcttggacaactgtgaagatagtgccttttgctgagatggagaatattagaa

SEQ ID NO: 4918 - DNA, 201 bp, Homo sapiens
caaggagggcaaatggatttctgctgtatttagaatgccacggtaaaaactttgtatttattaggtatggagaatgagagggaagtgaaggctgatccccrgtttctggcttggacaactgtgaagatagtgccttttgctgagatggagaatattagaagaggagaaatttgagggaagggaaatgccaattttaattca

SEQ ID NO: 4919 - DNA, 201 bp, Homo sapiens
gcaaatggatttctgctgtatttagaatgccacggtaaaaactttgtatttattaggtatggagaatgagagggaagtgaaggctgatccccagtttctgrcttggacaactgtgaagatagtgccttttgctgagatggagaatattagaagaggagaaatttgagggaagggaaatgccaattttaattcagccttctc

SEQ ID NO: 4920 - DNA, 201 bp, Homo sapiens
aaagcaagagatttggataaagaaatggcagtggcaaggagggcaaatggatttctgctgtatttagaatgccacggtaaaaactttgtatttattaggtrtggagaatgagagggaagtgaaggctgatccccagtttctggcttggacaactgtgaagatagtgccttttgctgagatggagaatattagaagaggaga

SEQ ID NO: 4921 - DNA, 106 bp, Homo sapiens
agcccygggaggtgcagggcccagtctgcccatctcgaccccagtgctctcctgccaggctgccctccggcccggccccaggtccatcttcatgtactcctcagtg

SEQ ID NO: 4922 - DNA, 201 bp, Homo sapiens
cctgccaggctgccctccggcccggccccaggtccatcttcatgtactcctcagtgccagtctcttcctctctgggagctggctggagctgggatggacayctgacagaaggaaattaaaattttaagggctaattccccttcattcaagaaatatttactgtgatgaagacatgttccatgcagaggaaatggccaatgc

SEQ ID NO: 4923 - DNA, 201 bp, Homo sapiens
actagaacctccaagcaagcgctcaggaattggcaacacggagaagcttcttgagctcagtgtgattatggcagaaactctgaagctaaagaaacttcccwtgttgctgtggtcacagctcaaggggacatgaagaaacctttaaggatggaggtgtgtctactgtcttcatcctggtgatgctttcataggtatggacac

SEQ ID NO: 4924 - DNA, 201 bp, Homo sapiens
ctcagtgtgattatggcagaaactctgaagctaaagaaacttcccatgttgctgtggtcacagctcaaggggacatgaagaaacctttaaggatggaggtrtgtctactgtcttcatcctggtgatgctttcataggtatggacacaatatcaaaatgtattcaattgtacaccctagaaatgtgcactttattgtgtata

SEQ ID NO: 4925 - DNA, 201 bp, Homo sapiens
ctctatttttttctgtattgtcactcccatgttctttcacatgcattctgccttcaccaggatgtcattaaactcgcctgtgctgataccaccttcaaccractgtacccagctgtgcttgtagtctttatatttgtgctggattatctgattatcttcatctcctatgtgttgatactcaagactgtcctgagcattgcc

SEQ ID NO: 4926 - DNA, 201 bp, Homo sapiens
gttttattgccatctgcaaccctcttagatatacctctgtacttactaatactcgagtagtgaagattgggctgggagttctgatgaggggatttgtatcsgttgttcccccaatcaggcccctctatttttttctgtattgtcactcccatgttctttcacatgcattctgccttcaccaggatgtcattaaactcgcct

SEQ ID NO: 4927 - DNA, 201 bp, Homo sapiens
ctatgggtggaaggaaaaaattctgagaatgatatagtcgaagtgataccttgaaggtagaactgtgcactgtggtaataacagaaacagaaagacgacawttcttctatataaacccaggatgtcgtccagcagcagctcccatcccttcctattgactggttttccaggcttggaggaagctcatcactggatttccgt

SEQ ID NO: 4928 - DNA, 201 bp, Homo sapiens
tcttcactgaaactattacagttagatctcatctctatgggtggaaggaaaaaattctgagaatgatatagtcgaagtgataccttgaaggtagaactgtrcactgtggtaataacagaaacagaaagacgacatttcttctatataaacccaggatgtcgtccagcagcagctcccatcccttcctattgactggttttc

SEQ ID NO: 4929 - DNA, 201 bp, Homo sapiens
tgcattaccagtcctaggacagaatatggatgctgaaaaatgattctttcaaagtgctgagttgttgcctcacgcccagttgtctggcatctcttcactgwaactattacagttagatctcatctctatgggtggaaggaaaaaattctgagaatgatatagtcgaagtgataccttgaaggtagaactgtgcactgtggt

SEQ ID NO: 4930 - DNA, 201 bp, Homo sapiens
cctcttagatatacctctgtacttactaatactcgagtagtgaagattgggctgggagttctgatgaggggatttgtatccgttgttcccccaatcaggcycctctatttttttctgtattgtcactcccatgttctttcacatgcattctgccttcaccaggatgtcattaaactcgcctgtgctgataccaccttcaac

SEQ ID NO: 4931 - DNA, 201 bp, Homo sapiens
ttttattgccatctgcaaccctcttagatatacctctgtacttactaatactcgagtagtgaagattgggctgggagttctgatgaggggatttgtatccrttgttcccccaatcaggcccctctatttttttctgtattgtcactcccatgttctttcacatgcattctgccttcaccaggatgtcattaaactcgcctg

SEQ ID NO: 4932 - DNA, 201 bp, Homo sapiens
tgagcccatgtacttctttctggccatgctggctgccacagacctggggctggccctgaccacaatgcccacggtgctgggagtcctctggctggatcacrgggagattggaagtgcggcctgcttttcccaggcctactttatacactcactttcctttctcgagtctggcattctgcttgccatggcctatgaccgttt

SEQ ID NO: 4933 - DNA, 201 bp, Homo sapiens
atagtcgaagtgataccttgaaggtagaactgtgcactgtggtaataacagaaacagaaagacgacatttcttctatataaacccaggatgtcgtccagcrgcagctcccatcccttcctattgactggttttccaggcttggaggaagctcatcactggatttccgtatttttcttgttcatgtatatatccatcctttt

SEQ ID NO: 4934 - DNA, 150 bp, Homo sapiens
atgttgagaaggaacaacatgatctaagtctttagaaaccaagagccacractagctgaggacacaagaattttcacaaaacaaagtagagtgattccatagatcactattatagctgcattaccagtcctaggacagaatatggatgct

SEQ ID NO: 4935 - DNA, 201 bp, Homo sapiens
ttctgagaatgatatagtcgaagtgataccttgaaggtagaactgtgcactgtggtaataacagaaacagaaagacgacatttcttctatataaacccagratgtcgtccagcagcagctcccatcccttcctattgactggttttccaggcttggaggaagctcatcactggatttccgtatttttcttgttcatgtata

SEQ ID NO: 4936 - DNA, 201 bp, Homo sapiens
cttctcattaaggaagatcacaatcttcatgagcccatgtacttctttctggccatgctggctgccacagacctggggctggccctgaccacaatgcccamggtgctgggagtcctctggctggatcacagggagattggaagtgcggcctgcttttcccaggcctactttatacactcactttcctttctcgagtctggc

SEQ ID NO: 4937 - DNA, 201 bp, Homo sapiens
cgcccagttgtctggcatctcttcactgaaactattacagttagatctcatctctatgggtggaaggaaaaaattctgagaatgatatagtcgaagtgatwccttgaaggtagaactgtgcactgtggtaataacagaaacagaaagacgacatttcttctatataaacccaggatgtcgtccagcagcagctcccatccc

SEQ ID NO: 4938 - DNA, 201 bp, Homo sapiens
ctggggctggccctgaccacaatgcccacggtgctgggagtcctctggctggatcacagggagattggaagtgcggcctgcttttcccaggcctactttayacactcactttcctttctcgagtctggcattctgcttgccatggcctatgaccgttttattgccatctgcaaccctcttagatatacctctgtacttact

SEQ ID NO: 4939 - DNA, 201 bp, Homo sapiens
acgcccagttgtctggcatctcttcactgaaactattacagttagatctcatctctatgggtggaaggaaaaaattctgagaatgatatagtcgaagtgakaccttgaaggtagaactgtgcactgtggtaataacagaaacagaaagacgacatttcttctatataaacccaggatgtcgtccagcagcagctcccatcc

SEQ ID NO: 4940 - DNA, 201 bp, Homo sapiens
ctgtgctgataccaccttcaaccgactgtacccagctgtgcttgtagtctttatatttgtgctggattatctgattatcttcatctcctatgtgttgataytcaagactgtcctgagcattgcctccagagaggagagggccaaggctctcattacctgtgtctcccatatctgctgtgtcctggttttttatgtcacagt

SEQ ID NO: 4941 - DNA, 201 bp, Homo sapiens
gccatgctggctgccacagacctggggctggccctgaccacaatgcccacggtgctgggagtcctctggctggatcacagggagattggaagtgcggcctscttttcccaggcctactttatacactcactttcctttctcgagtctggcattctgcttgccatggcctatgaccgttttattgccatctgcaaccctctt

SEQ ID NO: 4942 - DNA, 201 bp, Homo sapiens
caatgcccacggtgctgggagtcctctggctggatcacagggagattggaagtgcggcctgcttttcccaggcctactttatacactcactttcctttctygagtctggcattctgcttgccatggcctatgaccgttttattgccatctgcaaccctcttagatatacctctgtacttactaatactcgagtagtgaaga

SEQ ID NO: 4943 - DNA, 201 bp, Homo sapiens
ttctggccatgctggctgccacagacctggggctggccctgaccacaatgcccacggtgctgggagtcctctggctggatcacagggagattggaagtgcrgcctgcttttcccaggcctactttatacactcactttcctttctcgagtctggcattctgcttgccatggcctatgaccgttttattgccatctgcaacc

SEQ ID NO: 4944 - DNA, 201 bp, Homo sapiens
tacaccattattgaataaataatgaataaataaataaataaagatgtatgtccttcccaagtatatcagagaactatctggacaatttctttctttcccarttctcagaatcagcagtattctgtcaagaaacatttatcgacgatgatggcaatagtcgattaaaatcagatgaagttttatttttaaaaaaaggttgag

SEQ ID NO: 4945 - DNA, 201 bp, Homo sapiens
tgactccctgctcccagatcctgtagcccttattattgacacctttcatttagaaatttagcacatgtcacattacaccattattgaataaataatgaatraataaataaataaagatgtatgtccttcccaagtatatcagagaactatctggacaatttctttctttcccaattctcagaatcagcagtattctgtcaa

SEQ ID NO: 4946 - DNA, 138 bp, Homo sapiens
ggaattgggaagaaggataaatacatacatggaggagmaatagaagtctaccttatggagcatgtggaaatatcaggtggcttcttcaaatgatttttaagtatctcgatgatgatgaagaacaaagacatcaatcag

SEQ ID NO: 4947 - DNA, 201 bp, Homo sapiens
tttctttcccaattctcagaatcagcagtattctgtcaagaaacatttatcgacgatgatggcaatagtcgattaaaatcagatgaagttttatttttaaraaaaggttgagcggagagacaaggctgaaggtttggaagttgagacaaccatcttcaataaacgttttctcatctaagggctgtatgtacatcattttgg

SEQ ID NO: 4948 - DNA, 201 bp, Homo sapiens; identical to SEQ ID NO: 4944

SEQ ID NO: 4949 - DNA, 201 bp, Homo sapiens; identical to SEQ ID NO: 4945

SEQ ID NO: 4950 - DNA, 201 bp, Homo sapiens; identical to SEQ ID NO: 4947

SEQ ID NO: 4951 - DNA, 201 bp, Homo sapiens; identical to SEQ ID NO: 4944

SEQ ID NO: 4952 - DNA, 201 bp, Homo sapiens; identical to SEQ ID NO: 4945

SEQ ID NO: 4953 - DNA, 201 bp, Homo sapiens
tctggtgggtttatcaggggtttctgcttttgcttcttcctcagtttctcttgctgccaccgtgtaagaaggaccttttgcctcccaccatgattctaagkcctccccagccacgtggaactatatcaggtggcttcttcaaatgatttttaagtatctcgatgatgatgaagaacaaagacatcaatcaggattcaggaa

SEQ ID NO: 4954 - DNA, 190 bp, Homo sapiens
tattccgtgatattgaataagtctcacaagatctggtgggtttatcaggggtttctgcttttgcttcttcctcagtttctcttgctgccrccgtgtaagaaggaccttttgcctcccaccatgattctaaggcctccccagccacgtggaactatatcaggtggcttcttcaaatgatttttaagtatct

SEQ ID NO: 4955 - DNA, 193 bp, Homo sapiens
tattccgtgatattgaataagtctcacaagatctggtgggtttatcaggggtttctgcttttgcttcttcctcagtttctcttgctgccaccrtgtaagaaggaccttttgcctcccaccatgattctaaggcctccccagccacgtggaactatatcaggtggcttcttcaaatgatttttaagtatctcga

SEQ ID NO: 4956 - DNA, 201 bp, Homo sapiens; identical to SEQ ID NO: 4947

SEQ ID NO: 4957 - DNA, 201 bp, Homo sapiens
caagaaactgatgagaacggacaagtgttttttgttgaccatataaataaaagaaccacctacttggacccaagactggcgtttactgtggatgataatcygaccaagccaaccacccggcaaagatacgacggcagcaccactgccatggaaattctccagggccgggatttcactggcaaagtggttgtggtcactgga

SEQ ID NO: 4958 - DNA, 201 bp, Homo sapiens
ccgctcagctcctgcccgtgtcattgtggtctcctcagagtcccatcgatttacagatattaacgactccttgggaaaactggacttcagtcgcctctctscaacaaaaaacgactattgggcgatgctggcttataacaggtccaagctctgcaacatcctcttctccaacgagctgcaccgtcgcctctccccacgcgg

SEQ ID NO: 4959 - DNA, 201 bp, Homo sapiens
cctccatggtgcacatgtgatcttggcctgcaggaacatggcaagggcgagtgaagcagtgtcacgcattttagaagaatggcataaagccaaggtagaarcaatgaccctggacctcgctctgctccgtagcgtgcagcattttgctgaagcattcaaggccaagaatgtgcctcttcatgtgcttgtgtgcaacgcagc

SEQ ID NO: 4960 - DNA, 201 bp, Homo sapiens
cctacttggacccaagactggcgtttactgtggatgataatccgaccaagccaaccacccggcaaagatacgacggcagcaccactgccatggaaattctscagggccgggatttcactggcaaagtggttgtggtcactggagctaattcaggaatagggttcgaaaccgccaagtcttttgccctccatggtgcacatg

SEQ ID NO: 4961 - DNA, 201 bp, Homo sapiens
tgttttgtgccgctcagctcctgcccgtgtcattgtggtctcctcagagtcccatcgatttacagatattaacgactccttgggaaaactggacttcagtygcctctctccaacaaaaaacgactattgggcgatgctggcttataacaggtccaagctctgcaacatcctcttctccaacgagctgcaccgtcgcctctc

SEQ ID NO: 4962 - DNA, 201 bp, Homo sapiens
gctcctccaggatgttttgtgccgctcagctcctgcccgtgtcattgtggtctcctcagagtcccatcgatttacagatattaacgactccttgggaaaastggacttcagtcgcctctctccaacaaaaaacgactattgggcgatgctggcttataacaggtccaagctctgcaacatcctcttctccaacgagctgca

SEQ ID NO: 4963 - DNA, 201 bp, Homo sapiens
tctccaacaaaaaacgactattgggcgatgctggcttataacaggtccaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcct

SEQ ID NO: 4964 - DNA, 201 bp, Homo sapiens
gcctccgggctgggaggagagaaccaccaaggacggctgggtttactacgccaatcacaccgaggagaagactcagtgggaacatccaaaaactggaaaawgaaaacgagtggcaggagatttgccatacggatgggaacaagaaactgatgagaacggacaagtgttttttgttgaccatataaataaaagaaccaccta

SEQ ID NO: 4965 - DNA, 201 bp, Homo sapiens
ggccgggatttcactggcaaagtggttgtggtcactggagctaattcaggaatagggttcgaaaccgccaagtcttttgccctccatggtgcacatgtgaycttggcctgcaggaacatggcaagggcgagtgaagcagtgtcacgcattttagaagaatggcataaagccaaggtagaaacaatgaccctggacctcgct

SEQ ID NO: 4966 - DNA, 201 bp, Homo sapiens
ggacctcgctctgctccgtagcgtgcagcattttgctgaagcattcaaggccaagaatgtgcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccg

SEQ ID NO: 4967 - DNA, 201 bp, Homo sapiens
atcgatttacagatattaacgactccttgggaaaactggacttcagtcgcctctctccaacaaaaaacgactattgggcgatgctggcttataacaggtcsaagctctgcaacatcctcttctccaacgagctgcaccgtcgcctctccccacgcggggtcacgtcgaacgcagtgcatcctggaaatatgatgtactcca

SEQ ID NO: 4968 - DNA, 201 bp, Homo sapiens
gccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggccccttccaaatgtccctccaac

SEQ ID NO: 4969 - DNA, 201 bp, Homo sapiens
gtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtt

SEQ ID NO: 4970 - DNA, 201 bp, Homo sapiens
aagaacggcttggcagccagtccggctaagtggagctcagagcggatgggcacacacacccgccctgtgtgtgtcccctcacgcaagtgccagggctgggycccttccaaatgtccctccaacacagatccgcaagagtaaaggaaataagagcattcacaacagagtgaaaaatcttaagtaccaatgggaagcagggaa

SEQ ID NO: 4971 - DNA, 201 bp, Homo sapiens
acacccgccctgtgtgtgtcccctcacgcaagtgccagggctgggccccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgc

SEQ ID NO: 4972 - DNA, 201 bp, Homo sapiens
agtgaaaaatcttaagtaccaatgggaagcagggaattcctggggtaaagtatcacttttctggggctgggctaggcataggtctctttgctttctggtgstggcctgtttgaaagtaaaaacctggttggcgtgtaggttccgtatctccctggagaagcaccagcaattctctttcttttactgttatagaatagcctg

SEQ ID NO: 4973 - DNA, 201 bp, Homo sapiens
aagcagggaattcctggggtaaagtatcacttttctggggctgggctaggcataggtctctttgctttctggtggtggcctgtttgaaagtaaaaacctgsttggcgtgtaggttccgtatctccctggagaagcaccagcaattctctttcttttactgttatagaatagcctgaggtcccctcgtcccatccagctacc

SEQ ID NO: 4974 - DNA, 201 bp, Homo sapiens
gggaattcctggggtaaagtatcacttttctggggctgggctaggcataggtctctttgctttctggtggtggcctgtttgaaagtaaaaacctggttggygtgtaggttccgtatctccctggagaagcaccagcaattctctttcttttactgttatagaatagcctgaggtcccctcgtcccatccagctaccaccac

SEQ ID NO: 4975 - DNA, 201 bp, Homo sapiens
tgtaggttccgtatctccctggagaagcaccagcaattctctttcttttactgttatagaatagcctgaggtcccctcgtcccatccagctaccaccacgrccaccactgcagccaggggctggccttctcctacttagggaagaaaaagcaagtgttcactgctccttgctgcattgatccaggagataattgtttcatt

SEQ ID NO: 4976 - DNA, 201 bp, Homo sapiens
tccctggagaagcaccagcaattctctttcttttactgttatagaatagcctgaggtcccctcgtcccatccagctaccaccacggccaccactgcagccrggggctggccttctcctacttagggaagaaaaagcaagtgttcactgctccttgctgcattgatccaggagataattgtttcattcatcctgaccaagac

SEQ ID NO: 4977 - DNA, 201 bp, Homo sapiens
tctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaa

SEQ ID NO: 4978 - DNA, 201 bp, Homo sapiens
gtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggata

SEQ ID NO: 4979 - DNA, 201 bp, Homo sapiens; identical to SEQ ID NO: 4957

SEQ ID NO: 4980 - DNA, 201 bp, Homo sapiens; identical to SEQ ID NO: 4960

SEQ ID NO: 4981 - DNA, 201 bp, Homo sapiens; identical to SEQ ID NO: 4964

SEQ ID NO: 4982 - DNA, 201 bp, Homo sapiens
ggccgggatttcactggcaaagtggttgtggtcactggagctaattcaggaatagggttcgaaaccgccaagtcttttgccctccatggtgcacatgtgaycttggcctgcaggaacatggcaagggcgagtgaagcagtgtcacgcattttagaagaatggaaaacaaaataccaccctccgccagaaaagtgcagaata

SEQ ID NO: 4983 - DNA, 201 bp, Homo sapiens; identical to SEQ ID NO: 4969

SEQ ID NO: 4984 - DNA, 201 bp, Homo sapiens; identical to SEQ ID NO: 4957

SEQ ID NO: 4985 - DNA, 201 bp, Homo sapiens; identical to SEQ ID NO: 4958

SEQ ID NO: 4986 - DNA, 201 bp, Homo sapiens; identical to SEQ ID NO: 4959

SEQ ID NO: 4987 - DNA, 201 bp, Homo sapiens; identical to SEQ ID NO: 4960

SEQ ID NO: 4988 - DNA, 201 bp, Homo sapiens; identical to SEQ ID NO: 4961

SEQ ID NO: 4989 - DNA, 201 bp, Homo sapiens; identical to SEQ ID NO: 4962

SEQ ID NO: 4990 - DNA, 201 bp, Homo sapiens; identical to SEQ ID NO: 4963

SEQ ID NO: 4991 - DNA, 201 bp, Homo sapiens; identical to SEQ ID NO: 4964

SEQ ID NO: 4992 - DNA, 201 bp, Homo sapiens; identical to SEQ ID NO: 4965

SEQ ID NO: 4993 - DNA, 201 bp, Homo sapiens; identical to SEQ ID NO: 4966

SEQ ID NO: 4994 - DNA, 201 bp, Homo sapiens; identical to SEQ ID NO: 4967

SEQ ID NO: 4995 - DNA, 201 bp, Homo sapiens; identical to SEQ ID NO: 4969

SEQ ID NO: 4996 - DNA, 200 bp, Homo sapiens
tcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtt

SEQ ID NO: 4997 - DNA, 201 bp, Homo sapiens
cggggaggacgcgcactccagcgcagcgcgtgcggtgcaaagtgaaagtaactgttaaggagcttcagggaaaagggtccagggttcccagtaggggccgscccccttggtgggcctcgggtccagcgggggtcacctggtggcttcccggcgcgccctctgctgttcaggatgcagcactgcgcggcgcggcgagggcaa

SEQ ID NO: 4998 - DNA, 162 bp, Homo sapiens
ttcccagtaggggccggcccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgc

SEQ ID NO: 4999 - DNA, 100000 bp, Homo sapiens
gtggatcagttgatcccaggagttcgagactgtagtgagctgtgatgatgccactgtacccagcctgggagacagtgcaagaccctgtctcaaaaataaataaataaacaaacaagtaaataaaataagaaaaataaagagacccagcaggttagtgacttcggcagataacatcaattggttcagactgcaggttctggagccagacacaaatgggttcaaatcctacctctgctattactagttgttgggcagagtcagctcttgactggtagaccaggcctgttttactaccctaaatgctctcagtaagattgctaatgtcctgagtcatttttctgatggagaactcagaaatgagtcatctttccttcccctcttcaccccaatcccaattcccctcccaaagagcaagggcacccaaatatctttttacctgcccagctatgctgcatataccaggggcacccaagacaaccacctcttgaagaataatttgctgtgactttctacctggcaacctctactggagtcacatccagtggaggagtctgtgttcatgaataggaaaagggctgtgcttgtgaccgaatgtatgaaaaagagaccatgtgtgacccttagtagctatgtgaccttcggtgccttggccttggagtcttttttttttttttttttttttttttaagaaggagtttcactctgtcgccaggctggagtgcagtggtgcgatctcaattcactgcaatctccatctcccaggttcagcgattctcctgcctcaacctcctgagtagctgggactacaggcacatgccaccatgccggctaatttttgtatttttagtagagacggggtttcaccatgttggccaggctggtcttaactcctggcctcaagtgattcgcctgcctcagactcccaaagtgctgggattacaggctcatccaccgtgcctggccatagtcctcattaggaaaaaaaaaaaaaaagcagcattggggttggtttgatcatcgccaagggcctccacagtttcaagatggcatgcctcaatgatccaggtaccaggaaacatgacctctctccttagcatccagacatttccctgagacgctttcccataggcacagactctgacagagtatctgtggagtgaatgatgagacttttgggcaccctggccttgggaagttggcctgacatggtctgacttcagggccatcaaagcactgtctgagggactgctctgaccagtcacagctgagtgacagagcttaagttggagccagcttcctgtgcaatggtgagtgagcctacaagaaagacatttcctacaggagaggcctggcctccctggacatggaagctgccctcctatggtgagtgtgagaaggggcacccaatgtgcttcccttggggtgcagcggtgtggccggcccaggtatgtggaagagctgctccttgttctttccttagagaagtctttgtcggttctgttagccagggttctctagagggacagaactaatagatagatgtatatataaaggggagtttattttattttattttattttttattttttttggacggagttttgctcttgttgcctaggctggagtgcagtggaacaatctcagctcactgaacctccgcctcccaggttcaagtgattttcctgccacagcctcccaagtagctgggatacaggtgtacaccaccatgcctggctaattttttgtatttaatagagctggggtttcacatgttggtcaggctggtcttgaactcctgacctcaggtgatccacccgtctcggcctccaaagtgctgggattacaggcatgagccaccgtgcccagactaaaggggagtttattaagaatattgactcacatgatcacaaggtgaggtttcacaatagacttcaagctgagaagcaggaagccagtccgagtcccaaagctgaagaacttggagtccgatgttccagggcaggaacattcagccccaggggaaagatggaggccagaaaactaaaccagtctagtctttccatatctgcctgcttttattctggctgtgctggcagctgattagacggtgcctacccagattggggtgggtctgccagtccactgactcgaatgttaatctcctttggcaacgccctcacagcacacccaggaacaatactttgcatccttcaatccaatcaagttgatactcagtattaacatcacagttgatatagctgctatgaagaagtttttcttatcatctgaaactctttgagagcaaaattctgctcagcatcctaagctgcattgagaattaagcttggcagcatagatgagtaaggctgtcatgatcttatacacgctgtcacagtctctgcatgtatggtgaagttcaggtgcctgacacacgatgtgctccaccctggtgacatgtccaccccagtgcaactccacctcctgtgcctatgtttagaggcacagtgtcccttccaatgaagggctgccttctttcctattcaaaagaggccatatcagtttgatttatctttctataagtctgatcatgaataattaaaaccctgaataccagtatttttcaagaaagacaaatccaatttcagggtcagcataatttatgagaatagcaagtgcagaggcatcatcagaatcccctatggatctaaaataatgtccgtgcttggccccacacctggagatcctgatggagtagatctagagtgggcatagcatctgtgttttattttctttatttattttttttgggacaaagtctcactctgtcactcggctggagtgcagcagtgtgaacacttgggttgtcatcatgttgcccaggctggtttcaattcctgggctctcatcatgttgcccaggctggtttcaaactcctgggctcaagtgatctcctgccttagcctcccaaagttctgggagtacaggcgtgagccactgcacccagccactctgtattttaaaaagtcccatagataaaacccacatatccattgcaggagactggataacaaagtgtggcttatccatgcaatagagagctagctgctcaacaataaaaaataaaaagctgttgatacatgcaacaacacagaggaatcttctagacatcagggtaagtgaaaaaaccagtcaccaaagaatacatagtgtaaaattccacttatatgaagttcagaaaagggcaaactaatacatggtattagaaatcaaaattgtagtttacactgaatggggggagtgggatgacaacaaagggacacaagaaaacttcctggtggtgatgaaaatactctgtacctcatttacgtgacggtctatgtggatacacacaatctcaaaagtaacaaactggctgggtgcatggctcacacctgtaatttcagcctttgggaggccaaggccagaggatttcgtaaagacagagtttgagaccagcatggacaacatagcaacacccaatggctacaaaaaataaaaaattgccagatgtggtggcatgtgctaaccaccacaagtcctaactacttgggaagctgagcagaaggatcacttgagcctaggagttcaagttaatagtgagctacgaccacaccactgactccagcctgggcaagagtgagaccctgtcaaaaaaacaaaacaaaacaaaacaaaccacaaaaaaataaaaaaacaccaaaaaaccttcacaaatgaaacccttgagagatatgcatttattgtctataatttataactcatttaaataaaatggcctaacttcccctttagacccaagccagagtcttgcatgggtgccaaggagtggcctaatcagttcagcccagccatagctcaagaaaggaaacattttcctgttccctgccttatattatacaatcccccattttaattactttccagcatttccctcacgctttctctgtcttttggattaaaaaaaaaacaaaacaaaaacccaggaaacccagcatagaacaaccagctcaataatgaatccatttgtctcccacactgtgcccttctcctgtctccatttcagcagccacatccacattcctggaagaagtcccctgcttccaggctacttcaaggtgcatgatgttgattgagcatctactatgtgccgaccttgttgacccctttattaaggctacttccttttcttttcaaaataatcctgagaatagatgtttttactgccccccatttccagattagtgatcaataaagggaagtaatataagtccaaaagtgatattttagtttgatccaggtgccatagcaaaacatcatcaacagcagagtttatttctctcacttcttgaggctgggaggtccaagatgaagcagcagcagactcatatttggggagggcctagttcctgttcataggccgatgccttcttgattaagtctcactggtggaaggacctagctgactctctggcatctcttttataagagcacaaatcccattttctctcatgaagccatgaagtcacctcctaaaggccccacctcctaataccatcaccttggagttaggattttatcctatgaatttgggggtgggaacacacacatttagaccgcagcagtgacattaggttaagtggaggaggcagggttggaacagtcattgcaaaacctcttagatttaagacccctttccttccaaggcctgaaaggcagacaggcgttggagatacaggtgatataaaaggggcagagctcctcccttgaccatgtatttcatgcccagtcgctagaattcagtcaaccaagccctcacacacccgggccgtcccatgttctctggctcacctcttctggagcttagaagtggcagcctcagggaggcttctgtttggtagaacttagaaggaagcatggggaaatgcagatgtctttgcttttaggattctggctccctgagatcagaggagtgggtcccgtacgggggtggcgaggcacagggagaagcattggagcagactctgtgtgtgtgtggtgtgtgtgtgtgtgtgtgtgtgtgtgtcggcgcgcctgtgcgtggagggggataactgacccagcgcgaggcactgggggaggaggaagcggtagcagagatctgaataattgattctcagccgcaccagacgcccgggagcgggcggagagcgtggttccaacaccacggacagcgcgcgcgccgccgcaggcgcccccgtcgccagccagccacctatcctggccttatttgcgccgtgcgctctcggaacgggtggccgcgctccgcgtcgccgccgagggactgcggggttgtctcgacccacctaggagagaggctgcgggcaggagacgctttcgcccgccggagctgaagcctcttgggcttgagcgggggctactgcgtctcgccggctgagaacaagtccctagttggtgtggagggcgccgctaccttccttctcctcttcctcggaggcgaccgcagcagaagacgccccgggaacccggctttgccagtgctgtgaaccagggtgtccaggcgctcacggactcccgctgggaagtggggagccgaacgcccggcgcggagctggcccagcagcgaaggcccggagggagctgcctttccccgcccgcgcctctctcggccggggaccgcggggatcccggccacacgcgagcgcgctcccacactcacacacacactcgccctcaaacacaccacccggagctgggttgcggagagggtgctccggcgcgctcagaggaccgggcagttgccgccggagtggggcaggaagcggagctagggatcttggaggggagctcctagggcttggccgatcatgggaccgggtgagcgctgagaatcgcggccgcagccatcagccctggagatgacaggagcggccactgctgagaactatgtggagagaggctgcggtgagtgctagcgcgggcgccgggcctgggaggcccccttgggaagggggaggtgggaggcctgaagagggaggaacggcaggatcacaagagggtcgctgcgtgggaaagatccacctccctcggggaaccgggccgcgggagcccgcgtccttccctccccctctcctactgctggctcgtcacaaactcagcagcgcccccccaccctcgttacctcctctttctctccctacctccctcgctcagcagccccggtcgcacaactcccagcagccggcgctggggaggtggtagggggtgcgggtggagtgcccagttagcttctcgtgggtggccaacctggggctcccattctcctgtgcaccctgagtggagctcccgctatcagccacaggggctgaggatccgcactgggggcgtcgtgggctcgggcttcagcttcccccctcttgtctagcccccctgggcgcataggggggcttgtgacactgcagactgcagccttcccctcaaccctccctcccctcgttggtgggctgaccctgctctccttctctcctccgccccgttagagccctgctgcagagcctccggctgggatagcgccccccgtgggggcgatgcggacagcgcgggacagccaggggagcgcgctggggccgcgcatgcgggaacccgctaaacccggtggctgctgaggcggccgagatgctcgtgcgcgcgcgcgccccactgcatcctcgaccttctcgggctacaggtacgtcccagagggagatcaggctccttgggccagggaggagggagactcgaccggagggagagcgggagagggatcagctagagagggagagggaaagcgggagggagcccagcggcgaagtgcaggaggggcaccaggggcgctgcggctccgcgctccgcggcgcttacccaggaacgtcgaggcctcttggagtcgcctcaacttcccccggctccagcagcgtccgtcccgagaggcgcgcgtcagggcaccgtgcacgaccgtgctggtatttgcaggtacgcagggctgtgcacctgccgcagttcatcgtgtgcaccacctgaggacatgtgaggactccggctggccgtgggcaccgctacagcatctgaggaagtgcgcagaaaagcgcgcgtgcctatgagcgtgtgcggcccactgcccactgcacctaggacttggcaacagcgcccgcagtagaaaggctagggaggggctgtacagtcacgtccgtctgggagcttcttgggagcctacctttccccctacgcacgttctttgccactcctacgcgctggcccgcggggggacgcgcctactctccagaattcagcattgcacacgcgcgcgtgagagagggtgtgtgtgtgtgaacatgtgtgtgtgcgtgtgtgtgtgcacggtgtgtgcacgcgcgcgtgtaggggtgggtgaaggactctccacggccccttggctcgagtggggcgagccccaagttccccaggcacagcggagcctgggcccaccaggcagcgtcccactcccaagcacttggggtgtactctgactgagaggagccgggtctgtagttggggctggcgtagagcaaagtgtgtggtgcacacgacgggctcgtagggggcggggtcagccaacagctgagctctcaagctgggacgcggggtctgggtgccgcctccgcacgccctgcggggctgtagttcgctccgcgccagcagggggcggggttgataacttggtcctctctatcccagtgggaggggttggatggagggtttattctgtgcacctaggagcttggtggggtacagacacgcgcggcgcttagggtctgtggcccgcggcgaacttggggaatgcggtgggggataggacagagatggggatggggaagtgcctggagacaggggatgaggaagctggatgcgagaggggctgggggatggagaattagctcgaattggagttgtggatagagttagagatggacgagggatgtggatggcgtcggggactcggaatggagtccgtgatcccagcagcctatctgctgctgagttccatgcctggctcctagagcaggaagccaagttggtaatccctttctctggtcgccttgctcaccgcggccctgcctctcactcttcaccttgcagggaccgtcagggcgactatgggcagagtgggctattggaccctgctggtgctgccggcccttctggtctgcgcggtccggcgccgagcgcggcggcggagaagggtccccccgcgctaaatattgcgggatgctgggtcacagccacgacgtgacagagcgcgaacttcgaacactgtggggccccggcaggcggcggggctgcccctggacgtgaacgtggtagctctgctgatgaaccgcaccgccccaagagcctcatcacgcacgtgtgcgacctcatgtccggggcacgcatccacggcccgtgtttggggacgacacggaccaggaggccgtagcccagatgctggattttatctcctccacaccttcgtccccatcttgggcattcatgggggcgcatctatgatcatggctgacaggtaaggccggaaactgatgccctgccaggacctgggaagccaccagctgcatggcagcgctgcaggtcttcggacgcccctagaatctgtcttgatgtgaagtgggggtgggggtggagggtcgtggccactggccctggtgagaaccaggtcttgcctctccaacccagaaatgatggaaatgccttttgccttgtttctgaaaatggtgtacacaggagcactttggtgtgtggtgccaggaagcgctcagaaaactgagaagtaggctgtggggtggtggtggtggcggtgtggcatgtttggagatttacgagtaccatggggcacagaggtgggcccaggagcactgggacatatgcttcctattttcacaatgccagttttacctgattgttttgtgggaaaatgtcattttttcctcttatggtaagtgactaaaactatttctaaaaattattaaatgtgggtggttctggaagaaaatgcaaagtttttaggtaaagcacaaaagggcagaaaaaatgtcagcttcctctgactctgcagttagaggaacagaggtggggagtttgagaagccctgggccgaggagcggaggagagacccgttcctcaaggggagtgggtgggagtggaaagaattaacccaaacccagagcatggagggcctggcattttccttacgtgttctttgtctggggctccaggccctcagatgaaggagttggctcctgaacaaagatgggtcttggtactaaagttgggagtctcaaaatgcaagaaagagtgtacaaaaatcagttggctctgaatgagagggaggtcttttttgtggacagcctgggagctttggtttggagaagaagggagagagatttgaagtttgaaggcgatgttatgacagcctggtttgggaattacacagaagtggagggaaggaaaaggctggaatgaagaagtaaagtgaggaatgagaaaaaagggaaagattggagttgtggtgtactgtcctctaagtcctgagaaaagattgggagttcagaaggcgaggaaagagtagtgtacttgtgtgccatagcctctagccctgagaccttcttggagagtgttccttagatgcaggagatattctagtggagtgagcagacattcactgtagcgctttccttttgatgcttcaaagcacttttatattcatcacatcagcttttgcttctgtttcagcgattcctaccactcctttggtaaccgtattaattctttcaggtctcctgggctgcagcacattcagctgtgcacacaattgatgcagtgtcttattaaacattcattttaaatgatttgcaggctagcaaattcctgtgtgtagctgagcattttcccagtcacttctcagttttggggggctcctgttgggaagaagagagtagggactagccatgctctgccaccactgacaatttcagaactgggagcatcttagggtttcttggagcatgctgtaactttcagatgaagtgactgagccatagggagttaagggaatttgccaagaccacatagtggctgatgtagctaggtagctgaattctgatcccaaggtgtgatcttccattccactaaatcaagcccatactttaatgatgtcaccatcttcaggagggacaagggatcagtttcattttgtgggaggggctgagcatggagactatgatgaatcacagcctagagggcttttgtatgggaggggccaatcttctaaagaagcattgagggagaagaacagccagtttccagccacgccttggagtatgattttgggatttaatattaccacggatcccttcttccttcttgagtttttctaaaggagtgatagactggaacagtaaccatactgaaagtgaaatttctggatccatgagggtttggcacaacccaatgagaaatctgggaaaagctgaattggaaaaggtggtgtgagactgggaggttccgggtagctttggctcttacttctaagtctcagtcgataggtgtgtggctcaggctgtcatgtgaccattcatccgaacgtaggcagagagaagccggaagagtgtagggtcatggaagggaaccccttgataggcagtgaccctgcctgctagtgaatcttgacccagtgaatggcaggttgtaccaactagaccagcaactgttcttcccttgaagggggcattagaaagaaagttttgagagtccagggagtatgggtggaaacattcttctctcctttgggatgaaactgcgttttgggatgtggaccaaaatgtgacctcacttaagagtaagaagagaaaaggaatcaggaaaggcaagaggaagatgagaaaagacatttccagagaaataaagaatagagacttaagaggggtggagagaagaagaatgaaagggtccattggttcaaaaatggaggaggggattcgataccctgattgttgttgggactttcagagttggtcttggagacattggccactctctgtgatctggtggaactgtagggagatgaggcaaggtggcagggaagcaaagagctcagtggaggaacatcggggtatatgtctggtccccatgtggaacggtgatattgagaggagttgggtgtaccaagagaagttggtttaaaaggtcgtattttgagaaactggggatgtatttagaaagagattgtctgagaggtgaacagcccttccttccattagtaacatatatagatggcttggcttctgccacatgtttcatttagagctgaacattgagtttatttgtctccaaagaaacgtcacggtgcattgtttaaaactctgccttgcctcgcttgcaaatggtattatgactacgcctcaaccttcctagattgacaaggcctctgcctcctgttaaaatgatgttgatttggaaagtcatccagaacacacgtgtgttatatttacttctacattggcaacatgatagtgccctgctggtaagaatagtagtcaatttggttatcagttaaaatgaacacacacacacactttttttaactttttttatttttatttttatttttactttaagttctagggtatatgtgacaacgtgcaggtttgttacatatgtatacatgtgccatgttggtgtgctgcacccattactcgtcatttacattaggtatatctcctagtgctatccatcccccctccccccacccctgacaggccccagtgtgtgatgttccccttcctgtgtccaagtgttctcattgttcaatcccacctatgagtgagaacatgcggtgtttggttttttgtccttgcgttagtttgctgaaatgatggtttccagcttcatccgtgtccctacaaaggacatgaactcatccttttttaggctgcatagtattccatggtgtgtatgtgccacattttccttctgtctgtctacttgacgttgaagaaaataacaaagccttataacaattgaaatgtcatgcaaatgtggtggattttgtggtgttaatttaatttacaatggaggtgctaatgttttgctcgcatcattgggtatcttgcaatataactaaattagaggtgaaaataaggctgagcgaggtggttcacacctgaatcctagcactttgggaggccaaggcgggtggatcacctgaggtcaggagttcaagacagcctggccaacatgcttaaaccccatctctacaaaaatacaaaaatcagctggatgtgtggcaggcccctgtaatcccagctactcaggaggctgaggcagggagaattgcatgaactgggaggtggaggttgcagcaagccaacatcatgccactgcgctctagcctgggtgacaagtgagactttgtctcaaaaaaaaaaaaaaaaaaagaaggaaaattaaaatcaataaatagaggtgaaaataatgctcgatgtagatgaagttctaatcttatcttggcttggccatttgaccctgtctaagtgaaatacactccagctgcagtaatagtccctggtaagcccagaaatgggctagatctttacacttctgctcagtgtccttaaccctctcaccccccatcactttccccatattcctaattgctccatgcaggaaaagacgaggctcagattttagctatatcatccatgccagttatcacttgggtttcgttttctatgttattcctatgcaagcctcatgcttctgccagagtgtaagtcgtttgagggcagattttttaaaaaactgtttatctgtattgtgtatttgacatgacaaatgcttctctcctccgcagacatataaaaataatgcctttcattgtagagcacttaggaaatacattgaaatttaaagaagataaaaatctctctccaatcctatcaccatgggtaaacattactgacactttggtgtatttccttttatctatttagtgcatgctcaggattttatagtatatatggtttttcttattgtgctttgccctctgtggctttcttagaggattcaagattttctttaattctggagaaaatctcagccgctatctgtggattctttctttccatcattctttctattctctccttctgaatatacatgcatatgtaagtcatgcgttgcttcatggtgggacacgttctgagaaatggatcgttaggtgatttaacgtgtgaacatcacagagtgcacttacacaaacctaggtggtatagtctgttacacaccaggctatgagctataggctcttgctcctaggctacaagcctctacagcatactctactgatgaatgctatactaaatattgtaagcaactgtaatacattggtgagtatttgtgtatcaaacatatctaagcacagaaaaggtacagcaaaaacttagaatataatcttatgggaccgcattgtgtacttgtggtccattgttgacctaaacctccttatgcagcacatgactgtatatatatatatatgtaatttctcagtcaattctccatgtatcttgtttttttttttttcagttctctgtttgtgctgtgtttgggaaggtttcttcaattctatactccagttaactaatcatttcatttgtgtctggtctattattttattttagaaagaaacagcatggatggtcattattttgactatctgttgagttatagatttcaacaaggatatactttatttccaagaaataattggttcctctttacacctccctgtttttttgtgttataaataatgaaaaactctctcactttgtgcatgtaactccctcccctgtcccttcaaagattaaaaaatatgtatttaaagttcttctctgattgctctagcatctttccttcttcagttgtgaagtccttcattgtagaatcagttagttggatgttcacatatgttctttaatttttgtttgtgaacttatttcaaggcaactttatgatttcttatgccctgtatctgtgagggtgtgtattttaagccaagcccatgtcagcagctcaggtttgtactctcttcccattctacgtggcctgtggtacagcttaggagtccatctcatgtaggtgacttcattttggctccttgacacagatagggtctgctttttggctgtgactaatggtggatggtgcagatgttccagcaccatccacagctacagcctgattctaggtccagttcttcccctttttccctggatggacattgacacctctgtctcatggctcatattggacctatcctccatggattatgtggctttgattcctacttgaaccctagagtcccgtctttcagttcatttatttttagggattactctctatttttgatcgtgattctcttttcttatttgcaagcaatactatgtaaatttaaaaataactaaaggttctttaaaaattctatgtcttaggagcagaaaaggaaggttactgagtgtgttcactcggttttgaccccgttttatttcacaacctgcttttatatatttttttaaacttgattatgtttcttggaattttcctttatcactacatagacttcttaaacttgattttcaatggctgcgagtgttcagttcataccacaattattttaacaatttctctctttttccaccattaatatattcatttgtgctccataggggcatccttttcagtacctcacacttgtcctgccctttcgtttgttacacggtaaatgtttgttgattgaatgaatctagtcattggctccgatgccgcttgttggagcttccggatgaacatatcacaatatggttcagggcattcgtgcagtgttgttccctcaatgctgactgatttcataggtgtttgccaatttttctcttctctctagtggcagataattaccagccatcctgaggattagcataaattggggggttacatacgaaagcctgtagagaactgctgagtaacagctcatcagcaggaggtggaagttggtgctcttgtacctggcagctccagagtttggatgcgagtgatgggccttcccattaaacactgagagcctcgaaaagggcagacgcacagatcggaatgttggtggagcccactcagctcctgctaagaggcatcaggtagttcctgggagagtggggagacctatctttagtcttttccatgaggatgtcagatgcgatcatcaacacctcctcacttaagtcatcagagaccaacaggcgtcccccggtagcgtgactcacactccaagtagccctcaggggttgctgacaatcgtttgggcctgaagagctgtggtctggtgggtttgcagcggtgtttatcttctttctcatagcctcaatggaaaatgctactgtaggcagagtgagtggggaaagagagagaaagagggctgtgcaaagagaaacaggaactgaatctctggtttgtaatagagagttggtagcctctgataagtatcacataaatgagacattataaggttattaattggtgtcttttgtttgtcctgcatccccacccttgatctttcaacttctaattctttgccaacattttaaagttggaagacatccattgaaaagaaaatccaaacttcatgctgctttgaaacagtcagaaggcctggccatacggccccgattccccctatggcaacagttggctggagatgaatctcatcccccaaccccactgccacgatccctgccctcccactgccatcctgggacaggacaggtgcccctcctttctaaattccccaaagtcacttcacttcacttcacttcactcatttatgttacatacacagatcctgaaggcacttggctgtgaggcctatgatgtaggtgagggaagtagctcttccagggctgctcctggataagacggcagatctatggcatgtatgcaaccatggatgccatgttactgctgccatcattaatctcctataacacctggccctgttgagcccactggccttaagccttctcaacacagtactccaggcagccatgatgaatcaacttgagttggaagatccaaaaaaccttggacaaagagtctgaagaatgaaattcaattttcaaaaatacctgtgtgacttagaaaaggcccttcacctgtctgaacctctggttctcctgcaaaatgaggatttgggcaaaattatcactaagatctcttccagctctgaaaattttgtgcctcatcaaggaaagatggcaacaaacataccaaaatatgaatagcagttatctttggggtggtagactcatggcgctttaatcttttaaagaatgtcattatcaagtggttaatatattgtactttgagttagttgcctgaatttaaattcagggattccacctcttactggctgggtgatcatggggaagtcttaatatcttgagcctcaatgtcttcatctctaaaatgggaacaataatagcatccacttgtagagttgtgagatttaaatgacatcatggatattagtccatgtctcagtgcctacttataataaatgcttattacaggaatgctattgttattgtgtctgcattttttagttttatttttctccagtgtacatgtactttttaataaccagaaagagtgattaaggatgatgtgttacatgagggtatgctctgaaagaaactgggagtgaatcccacagaactgtcagaagggagggtctaacatgaaatgatttgtattttcttaactgagacaatcagaagcttccttgcctttgtaggacttgctgagagctttatcctggcaaacggaagctaaatgtggccagctgaaagtgatcgtaggagaagactatctcattgacctttgcactaaatgactccaccaatggaccatatgtttgcacgaggcttagggatttagagtgtggacatatatagtttctcatttatctctgccaaggattaataactcagtgatagcctggggaacctggcagctccaacgtatttgtttaaagaatctctattttcagatgaggaaataaaggatctgggagttgcagaatttgtgcattgttcaaagctgtaactagaacctagggctttgggttcttattcttttctcttattttattaccctttcaagttaatgactacgaatacatttgatttagggaagggctcagatgcaagacaaataacagattttgatgttcatattttggttgtcttgactaaaagattaagatgttggatgatggaattaaaattcaaaacttcagattgaagtgatggagtcctctaaagactgcactggaggttccccccataccgcactcagctttaatgaggttaactacaaagaaaaattgtatatattaaaggtgtacaacacaatttttttttttttttttttaagaaaacagtgtttcactctgttgcccaggctggagtgcagtggcatgatcatagttcatgcagcctcaacctcctgggcttaggtgatcctctcatctcagcctcccaagtagctagaacacaggcgtgtgccatgatatccggctaatttttaaatttttggtagagacgggggttcaccatgttgcccaggctggtcttgaactcctggactcaagcaatcctcttcccttggctcccaaagtgctggtattacaggcataagccaccgtccccagccccaaatgatattctatatacaagtaaatgtgagatgattgtcaccatcaaactaattaacatatccattacctacatggttacatttattgtgtgatgagattacttaagatgtggtatcttagcaaattgctgtatacaatatatttttgtattgtcaccatgctatcaccagtcaccatgctatacattggtctctagaacctatttaccttacaagtggaagttggtgccttttgaccaacctctctaatagtttgaagaagaattttcactattgcagaaagggggatgtgagactttgcaactccttagtcataatgtggctgcctctgttccaactatcacatccaactcacttgggaatggttttgcaagggtcatgaaccggtgtactgcacgctgaatctggctcatagatgcatttttttcaccagtacagcatttttaaatgcttgaattttaatgtctttagacagcatgcatttcaaattcactacagctgtccccactctgttatcccatatctagggtgattcatacattatgttaatgatatggtttctgtgagtatttgagatcatggtgctcaaatacagacttttatttgtttgtttgtttattttgtattgaccagaagctcagcagatcctaagtggggatagtggaggccacatatctagaaatatatgtggaggccacatacgttgtggccttataaaagtggaggccacatttatagaaatataatgtttaaatcaagggaggtgatagctccattaacctcttctgttgtttggagtgctttcaggtgcaagtaacagagtctttgaccaacagttcttaaaccattaaagacattcagttttttgcttagtaaggagcctcagatctagcttatgacttaatgtcacattgaggactcagatccttcccattcttctactttgccttcctcactgctggtttatctgagtcacaatatggctgcttctgttccagccatcacaccttcacccctagcattcaaaactggaaaaaaagggagagaaaaataagccttcttctagggcctcttcctttcattggagtagacttcctcttacatgtcagtggccagaactgggtcacattccactgctcaaacaacaatgatagagatccaggattcctctctgagaatgggtaattgccatgagcaaaattgcttctgttagcaagggtgtggggtgatgcttcagtggtacaactggtatgtctccagcaacactaacaccattatatgtagcattgcacttagttccgaggagtgaatctaaagatggacgttgaaaaattgcaatgcatgcagaaaaagggcctttaggattgctagactctaaatgaaatatattaagagtttcagaagaagtatttagggatgtttagcctgagaagggaaatctcagaggggatatgggagaagtgttcagatactccatgggctgttaaaggtagaaggttaagtcttaattttgttattgttctggggacagacataagagtgaaatattattattattattattattattattattattattattattgttattatttgagacaagttttgctcttgtcgcccaggctggagttcaatggcacgatcttggtttactgcaaccctgccgcctgggttcaagtgatgctcctgcctcagcctcctgagtagctgggattacagcacctgccaccaccatcagctaactttgtatttttagtagagatggggttttaccatgtggccaggctggtcttgaactcctgacctcaggtgatccacccgctttggcctcctaaaggctggactacaggcgttagccacggcacctggccaagagtgaaactataaggagtaaagttcatcttgatatgaggaataagcttcggcaattaggtctctaacagaagactgtgaggttcatggaataggaaggctatatcaggatatgattgagctaacagtgactgtctgtccccaggaatgaggtggaaaattgggcttgcaaggttgggttgggtcacctctgaggctcttcttattcaaacactctgtacctctcaaatccttgatttttaaaaaaagatctccaagcctggtgctttaggccaagcatttggctgaaaaccaacatcctcactttttccaagtgtgtagtaattcagtataaatttgcctggcatggaggaggaatttataatccctgcatcatcactcaagttcccaaaagactttacattatcctgaaggtagaagatatttgaaaagcagacacctatgtatatatcaactcacacacacatatataaataaaaacataagtaggtcagccgcctcatatttactagtgaaaatgtttttggctaagaagctcatctacagaagacaatgttagaataattgccaatgatctcgaaatggggtgtttttgcacttgtatcaggttaatcttattacttaataaagtatattcagcttgttttgcacatcttactgtagtaatatgttttattctaaagagccagccagactcctctctggtttttcagttgacaaattattctttttgtcagttgtattctcctgcatttggaacatctgcttatggcagaaaatactctagatacattctgttgtttatccacttctcctattcccccacatccccccaaagaaaaacgaacctaaattgctttccaaatgctttcactttctgttcaaattttggaactttccatgggatggaattgatatattgtctccattttttaaactttgaaatagatgttgatgtacagagcgaaaaacctaaataatacaatagagcattcagagaaagaatatttgctccattaatgcatcgagatcttcgaactcaggttcccttccatggaggtggctatgttacccatttcaggagggaaatattaattggaatggaaatttctttctgtttgtgatttttttttgctgaagtcggctatggaaaggatcttctcttaaactacaatccctgacttgaaaactacaatccctgactgaaaaaggttaattgtttccattggtccctaacagtgactcttttgccaaaacaaaaataactcactctaaaatgtaagttgtgatttccaaaaatcactgacaccttgaagcttggccacaaactcactcaaagaatttaagataatttggggtgattttggggggagttggggacactttaaaatctaatgaaggctacggacccttccagaggagtgcgtgttcataaacatgagtcaaaattatgtgcaatttcaggggatcacagaccctctgaaaccctttcatagactccttggatttgatttatttattggtttattaaacacagttgatccttgaataatgcagggctagttgcattaacccccatgcagtttaaaatccatgtataacttttgattcccataactatagcccactgttgatcagaagccttaccaataacatagacagtcaattaatacaaatttctatgctatatgtattatatagtagattcttaagtaagccatagaaaagaagatcaaaggaaaatcgtaaggaagaaaatatgtttgctattcaagtggatgtgggtcatcataaggtcttcatccttgtctttacattgaggaggctgaggaggaggaggaagaggaggggttgtcttgctgcctcaggggttggcagagggagaagaaatttgcgtataggtagacgcatgagtgtgttgttcacaggtcaaatgtatgttcattcttcatacatttcttggctttgtcctggaccaaaatgctttgtggatgcatctgttatcaatttgtttcagaatctagctggaggactcataatgcaagtgcagtatgattgtattcacgggaccatgggaatgcagaggaggacagcttcatccacaggtctgagggtagggatctggggtcaaattggagagctggtctgaagaggcttgtgtcctgggtgcctgcccctacaggttgtcatcccccacagctgaagatagctgtagagggaaggctggctcatggaggagcagaattgagttcacaatctaagccttctctcctcttaacctgttcctcaaggctgccagtcttgagtggtcttgaaagcttccaattctcctctggatggcatttcttaccatcaaacattgagctttttgcagatttccgtttgttgtcacaaatggctgaatgtctcctgctctatcttgtctcttcaaattaggaataccgcccaggaagagtgagtggcatttgaaatccatatcgtcttgctagtctgctgtcctagggtgaaagaaaaagacatattttcctggcgaattgttttaatgctaagatatctgtaggctgaggaaatgtagtattaactgacttgggtgagtagactcagaacgatgtgaagaagcgtggagctgtggaaaaaggcaggcttgctgtagttctggtgttagggtgtgtgcatggctccatgaatgggattttgaaaatggcaggccttgggtgaagaccttcatggtcaaatttcactttagttaaaaacaaatttgctattggttttgccttggttaattgatactagttttcctcttctcttctcctctcttctttttctcttccctcccctcccttctccactcctctctctcttctcctctcccctcccctcctttctcccctcccctcctttctcccctcccctccttctcccctcccctcccctcccctctcctcttctctctctctctgtctctgtctctctctgtttagcagcattgaaagaaatatttttatcatggacccactgctggatcattttaaacaaatccaagacatcattgtgttcatcagtaaatatgtcagtatatatatatacatataatatatatatgtatatatatatcaaaaatataagaactttaagaactgttgaaaaaaatacagctaatatacaagtaatctatacatatgtattttagaggattttgtgagaatcaggcagtataaagaaaataaaaatcacctttactctcagcatccacagacaactgctattaaattttggtttatttccctctagtctgttttcctataccttatttacaaatacacactattaattttatagatagcttttaatttgcttaacattttatcatgaggctttcagattactgtaaacatttttatcttctatgttttctattctgtggatatctcatgatttacttgatatttagattttccccaattttttgccatgaaaaccaataccttgtttaacatctttgtaagaaatgtctacatcacagattattggcttttaatagaatccattactgaaattaaagaatttaaaactatcaatacagaaccaattaaggttccgttaatttgttcccagaaagattgatcactggacacttctaataactatgtcttaaagtatctctgtcacttaactctggctgctcttgaaacagaaatttttctgattggctagacaaaaatattaactcattgttataattgcatctcttttaagacacctgccatggaatatattttaatttaagcatcgcttttatatccctaggtattgcatattttaactgctttgatatttctcattgtgtaaatggaaaacccagacaatgatggcttccaatataacatacagtggagtaatttgaatttctaaaaaatataaatattttgaagcctggcggggagttctatgattattcattcttcatcaccaggcatgctcacccattgtctctgtatcagtgttgtttcaatcattgctttaatatgtaaaattttcagcagaaaatcattctgtgggaccccactgttatgatttgccaggagtctaggtagaactcacgtccaattgggctggagtcatgttcgtgtcccaggctttgtggggaacggtaggatgggaagcccttgtttgttcctttctctaaaaaagcagaggcagggtgaggttttgcgggtccgtcccgcagaccctgacccaatgacagatgaataaagttccctgacgcacagaattctgctttgccagtctagctgagtgtccgtgccacttacagacaccaaggaaggttcgtacagagtcagtggccacggcctcgacttgccagtgagactcacatttattcagtaaaattaattgacaaaggttgtgagtaaacacattggtgggtaattaacctggttgcccctacccggagagagccatcatgcactcaagaatgatcaaatattggtcttaagaccacgtgataaacaagctagttagataaactgctctgccttcctttgtacccacttcaagctatttattaaggtaaggattaggttgccttaagccataaacttattctcagacttttgcaaaaacttcaggccttccaagaaggtttgtggctattctctataaccaaaatttttcccaccagttgattgaatccccacaaggttgtaacaagaactgccttgtgataggaaagggatattgccaggtggcagggggcagtaaaatgagttttaaacaaaagtgggagagatttatgtttgaattaacagctgtgaggaatactcaaaatatttaaccactacagcattatcacagctgaacagaatagacactcactttgtagaattctggagcacctgttatgtgaggtgttaatccttagtggctggttatggggaggtagggggttcccaagggaggggctgagtggcagggggccttggggttcctggaagatgtggctattcacaagcaaaacggaagcatttcagcctttaataaccagttctgctgcaccagtgcacaccagccaggatatcagcgagatctcacgtgtatttatgccaacgtgtatgcagaagttttctcagggaactgtttagaaaaggacacaggtggctgtctcctctgccatatattaaccatgccctgaaaaagggaggtagggctgagagattttgaagatctctttcctaaaatatgaaaacagaaatgtgcttccttctaaccttccccttctgagcctggtgctttggcttgtctcttgtgggttaattttctagctgtctatcaaagcctgcctttctcccatgaaaagcacaggagctgaagccagctgtccatgccaccgccactccccactcccatgttccctgtcttctagggcaagagattcccaaacaattcctgtttcattggggttgaatgaagagggctgttttagtctctggttttggggtgtgatgtgctatttgcagaagcataaaaataatcttttaactcaccaaaaaatactccacagcctaaataactttgttaaagatcaactttcaaaagagagccttggatgtgccttcgtgggatcatggcttagtttacttgtagagtctgtggcttccttccctcctccgaaataggaaatcctcctccctgtcctggttcatggaggttttcaaatgggcttcaggagaaagaagcacgtctctgtttcatccgagggtaggagaaccctctgatatgttgtttattgttgagaatgcactgattgtatctccctaaaagtcatatattgggtcctaacccctagtatctctgaatgtgacatttggagctggagtctttaagagtaattatggtaaaatgagggcatataggtaagccttacccaacatgactggtgtccttataagaacaggaaattaagacacaacataaacacacaagggaggaccatgtgaagacacagggagaggatggccatctgtatgccaaggagacagtttcagaggagcaatcctgcagctcccttgtcttagacttctagctttgagaactgtgaaaaattacatttctgttgtttaaaccatctttgctgtaataaagactgtgatcctttgttcagcagcctgggaaaatgaatacagagaggttgggaggtagttagagcttaattccaagcttctcctcactcctcttctgtaactgagcctcagtggagtcaagacacctcagctcagacccagacctccacctgctctaacactgactttgttcttctcatgtgggctccctttctgacactaggctcctgctttgaggaactgagtccctgtcttagaatccttcctaaaaccctctaggacttctaggttcaatgcttctcaggaatttttactcaaatagtcctagggggttggtaggcagaatcatgtccccaccaccccctcttccccacccaaagacatccacattcaattcctggaacctgtgaatactaaccttatatggctaaagggactttgcaaatataataaattaaggatcttgaaatggagagactgttctggattagcctaggtgagtccaatttaaatcattccttatgaaagggaggcagggaggtgagagtcagagaagcagatgtggcaacgaagcagagattggagtgatgcactttgaagatggaggaaggggctgtaatccaaggaagccagcatcctccagaagctggagaaggcaaggagataggtcctcctctagggcctctgaaggaatgccaccctgccagctgcttgacccacttcagactttggacctctggagccatagagaaagaatctgtgctgcttagagccactaaattggtggtaatttgttagaacagcataggaagccaatacagggacagcgtctgataaacacacgctctgcacatcaggctgtgcctttgtggccttttctctgaatttgatcttaaaaattcatgcagattttggttcctacccataatgtaactatgttggtactaaggcgaaataatttaaaatgacttaaaagataagttgtccatttttcccttcatcaaatagttaagttgtattagttcgttctcacactgctaagaagacatacccaagactgggtaatttataaaggaaaaaggtttaattgactcacagttagtgtggctgggaggcctccggaaatttacaatcatggcagaaggggaagccaacatgtcttcttcatatggcagcagcaaggagaagtgtgagcaaaagggggaaaagcccctaatagaccatcagatcttgtgagaactcactcactatcatgagaacagcatgggggtaaccatctcatgattaaattacctcccaccaggtccctcccacaacacgtgaggatgatgggaacacaattcaagatgagatttgtgtggggacacagccaaaccatatcacaagtaaaagcaagctctaggaagttctactgtatttgtgctctgcacgtgtgttctgctgggctgtgtgtgctctgtttgagaaccctggggtggtatgcactttgaaacccgaaaccccaaaacctggcccacgaacgtgcctctgcgaaattcttcccaagcaaagtttccttatcatttttgtgccggaggggagaagagacaagaaattcaggatagctggagaatacagaaggaggaagagcaattaacagtgagctttctgttcgattgagcatttgtccacaatatattgagatcaagtttgtttcttaaacaaatctgttaacttttacggtcaatttggggcggtgcaaccggttagagaattcattaaaacagccaaaatctctggctccgctgaatgtgggaaagtctctgatgcctccaagcagttgtatgaaaaagatgaatcatcaacaatgcagagatgacatgagagagcagatggggctttgatccttcttgttaccaaaatcctacttagaatgtgttgtcatgagtccccacttcatgctgccatatcgtggttcctaaagccaggtctggggtacttgctgggtggaatttagaagctagaaacgaacttgctcaagtctacatcccatccacagttcacagcccttggtccacgcccacttgtgctgtgtgctcctgttctcttggtttggggagaccaatcccgcttgtattgatgacttcatcattctatacttccagcactcagaacattgttttagggagagtaggtacttagtagatgttcaaacaaaatagtgagttaggagaaggggctagtccaggattgtattagtttactacagctgctgtaataaattatcatcacaaacatggtgctgaaggaaacgcacttttaccctcttacagccctggagggcagaagtctgaaatcagttccctgcaccaaaatgaaggtgtcagcaaagctgtgctccctctggagactctggggagagtctgtttcctttcctttactagcttccagaactgcattccttgacttgcggcaaacctgaaattcagtttctcctgcaagtaagaaagttgggctaaatgctcttacagctttaaatctggccttctttgggtgggttccacataatgagaacgatagtttgtattgcaaaaattggagctttgagttaggcgatctgggatggaatttgagctttcatattctctctcacaagaataatatatttgtgtatcatttagctatctataaaataatatatattatctatctaaataatacctttatagtgtatcttcttccttcctctctcccttctggaccttacctttcccatctgtaaaatgggattgggctaaggtccactccttgacagactccgctgcttcttggagtcaggagtcactccagcctcattgatgatgatctgccttttgcatgcttgggggaccacacctctgtacaggcgagagccctccaagcatcccatcagctcctcttctctagatatgtccttagtagttggagctttgcagatgcctccacaatctacagttgtagcctcaacctttgccctgggttcctgacctgttcccctaggtgcttggtgggcttctctccttgacatgccatgggtgcctcacactgaacctgcccaggcctgtcctctttgattcatgcttattctgatttcttctctctgtcaatggtattcctgttgtccaagccttccttgcttggaaggaaatgaaggacggatgtatattgagctccctgatgtgcaggcagagtgttgcaggcagggaccgaggaccaccaccctcattgtagagaggaggaaagtgaagcccagggaatcacagaacttatttttggtgacactgctggtaggcaggtaacagagctgggccctgaactcaggtccctgactccacaacctctgtttttttgatcagaagaatttcttaagttttgtttccttcatggcaccttcacaacattttggccactttgactaattttttattgtgatataatacactaacatagaatctgccattctaaacattttaaagtgaacaattcagtggcgtttagtacttcacaatgttgtgtgaccagcacctccatctaggtccagaacatcatcactccaaaagagaccagtaaccatcaagcagttacgatctatttccccacccctccagctcctggaaactttaatctgctttctgtatctgtggatttactcgttctagatgggatgggatcgtctgtatgtgaccttttgcatctggcatctttcacttagcataatgttttcaaggtccatccattcgtagcatgaatcagtactttattccttttcatggctgaataatattccattgtatggtatactatatttaatttatctattcaaccattgatgggcatttgtgctgtttccatctgtagctattgtgaatggtgctgctataaacatttatgtacaagtttttgtttgaacacctttttcaattcttttggatttatacccaagagtgaaactgctgggtcacatggtaatacttgcttgacttattgaggatagatatccccctactcccaccaccagaatacttttctttaatcttaaaataaaatgatgccagatacagtggctcacgcctgtaatcctagcactttggaggctgagacgggtggatctcttgagcccaggagtctgggactagcctcggcaatatggggaatcctgtctctacaaaaaatatgaaaattagccgggtgtgttggcacatgcctgtgtcccagctgctcgagaggctgaagtagtaggatcacctgagcccaggaggttgaggctgagtgggctgtgattgggccactgtactccagccttggtgacagagtgagatcctgtctcaaaaataaataaataaataaataaaaataaatatagtttaaaagagaatggtatatcacgccaataatgaaaaccagtttcacttatgataagcagaagataacagcaaactaacaataaataaacaaacaaaatcttgccactagtaaaaaaaccaaaaataaagattacagtagtatattaaaatataacaaactactgttcctgccaagtctcacttagcatatgatatggttggctctgtgtcctcatccaaatctcatctcgaattgcaatccccaagtgttgaagaaggaagtgattgatcgtgggggctgtttcccccatgctgttctcatgatagtgagtgagtgattctcatgagatctgatagttttatagatggtagtctttcctgcatgctcacactctttctgtctccccgtgaagaaggtatttgcttccccttcatcttctgccatgattgtaagtttctgaggcctccccagccatgcagaactgtgagtcaattaaacctcttcctctataaatacccgtctctggtagtatttttatagcagtgtgagaatggactaatacagtatattatttctcctttaaataattagcaagtgttagaaaggtgttgaagacctattagcaccaagatagacttcctcactgactaattagaaggattgaaagataatcagagttttatcctgcatattttaatattattttgtgtctcatctaagtaagacataaaacaatctctgacactatactggccctctggtgttttccattcttccactgcccaactcttggttcgtctccatccctgcacctggtccttatcaccttccacctgaactttgattccagtcttctgagtttcctgctatacgggaagctctcctactcaaggggcgcattggacatgttactctccactcttaaagtttggtgatatcaacattatattcagggtaaattctaaacccttagccaggcatccaagatcacctcagtctgccccccatcaccaccaggctctgtctcccacagtgcacccatcagtgaattagataacttgttctttctttcacgtgcccatagttctagctccatcgctgagtcttcctcccacctccatctttacttttggaaagcacagttgaaatctacctctcagggtcttattaggatcgaatgaaataaggtgtatgaaaaccctgaaaactgtaagaagaaataaagtgtgaaacatgtcattgttagtcccgctttgcctttaagtcctttaagttttaagttcaagttctccaaggtgccttttccatttcttaggcttgaagcaatcgccttctgcctctatgcactcagtctttttttatgccagaagacagacagaatggcctccccacatgactggaatttattcctcttctatacccttgctgtagccattttcatcttcctcccctcagtgccagtatacgtgggttgaaagagcaaatctgtgcctacttgcaggagaaaccatcttgtctcaatcagaagtggagaaagctatagccacactgcctctgtcaaacatactttctttcctatttctcttccctcattagttgcatcttggaatgtgctttgtctaataggaagtgacatttaatcgtttgggtttttaaaatttatattctgctacacagctgaccacatgcgatgacaggcagcccagcattatggcatgagtccattccacttttgcatcagaagatttgggtgagccatgaaatggctgacctcatgcatagcaagagagttgaaaatcactgtgggggacagagctcttctagggagaaagaagtcaggtatgcgtgcaggtgcagagtgggcagatgggaggaagcctgacagttttcctggaccctgggctagatcacccttttcatcgtccagggtcctcctaccacttaaaatggatttctgtgcgattatttattcttgccccttcttttgaatcctttgagcctttgaacttgatatggtttggctgtgtccccacctaaatctcaccttgattgtagcttccataatcctcatgtgtcctgggagggattcagtgggaggtaattgaatatgggggcaggtctttcccgtgctgttttcgtgatagtgaataagtctcacaagatctgtggttttataaatgggagttcccctgcacatgctctcttgccatgtaagatgtgaccttcttctcatttgccttctgccatgattgtgaggcctccccagccatgtggaactgtgagtcattaaacctctttcccttataagttaccagtctccgatatgtctttattatcagtgtggaacagactaatacagagctctttcagtggaaaagataatacattaaatcgttataccaacgttataatcatggatggtattgcagtcacattatctgccaggagaattggcagggacgtagaagggatgtccactatttaacttgaaccatcatacagatgtgaaatatgaggctcgagaggctcagggacttgctgagggacacactgcttcctgagtaccagtcccatgggtccctggcccatcagatgttgattactggtgctgatgaaaagaccaacaaggatattcatttctgtgatgggggatggtaataaaacttcttcctgcaaactcaccatgtgcactgcattccttcagataaaatgtaaactcctggctgcacaaatccctgatttctgacccctgctgacttttgagcttcaactcagttctctcctcattttgcagtttgctctagactttcccaaaagggctctgaggaatatgaccctacagaaaaaagtttaagccaaaataaatttaagagagctgtacatcatgggatcctcagatatttacaatgcacatgagcctcttcaaagctctggaagtcctgcgctacagacacggtttaaacttatttcctgctgtttgaacgaatgtttccaaatctatttgatcagaagactccccttctgttttttatacaacacttgttcttgttgcttgataaaatatgacaaaaaccattgccctgattgctaaaatataacaaaaacccacatgctctaaatgtgcctctttcacattttctggcacttgtctgtgctgctatttctgtcttctcatatccttcaaaactcatctcagaagccatgccctctgagaaaccttggactgcttcccccacaggattaggtgccgttcctatacttttgtagctcctgcattctgataattttttgttgatttagcttcccagctgtcctcagtgaggacaggaacagtgtcttatgtgttatgtgttcagtgagtcattccataaacatgtactgagcctcctctacccaggcacacagtcagggcactgaggatgctgggggaacaatgtccctgcccttatcaaacttatattccagggatggggacaaaatataaacacggtaaatatataatgttagattgcattaagtgccaaggcaaagcagggtaaagagactgaaagtgacaggagatgccctttaagatagggtttcggaaagctggatcagctaggatggatgaggccctgctgcacaaacagcccctgtatcttatggcttataacaataaaggcttatttctcgttcatgcaacgtgcccaccgagggttggtacgacttctgcgccatatcgcctcacttgtgggaccagatggagcatggctggttgtttggtgtaggtggggagggggatgtggtgagtcatacgctggctcttaagggcttcagctacatttgattgccacaactgattcaaggggccaggaaagggctctcctgccatgtgcctgaacgagaggaaaactggactgtggggtggacagcattaatgaatgcacaggaaccctcctgacatgaggacttttgcacagagaccttaatgcagaaaggaggggagccttgtgaatcgtgggaggagggtggaggaaacagcacttgcgaagaccccgatgcccctccagcattcgcacggggtttgacatgaagtaggtgaccaggcagtgtttgttgaatgaatatcttgaatccaggacatgctgcattaaggagatctttccgtctcagttgtccaagtggcaggtctaatgaggtgagtgttcatttgtaagagtggaaaattctaaccagcccaaacaaagattgttggtattggagtctcaattataggacttagagtcagtatactgaacttagctctggctaaaaatttattttgacttgtcctctgactcaaggccaggatcttatgttctagcacaagaacaaggcagaaatatgtaaaatcaccctaactatagtagagtgtttagaaaaatgtttaaaaatacctataaaaatgaaaattagcttttctccttgtgtatacctgatgggtttatctatttgaaatgacttcatcactgtccagattccctgctaaactccacctgggcaggagctatccccttcatagagtccccccagcacctagatactgcctggcaagtgatggatggccatatatccagtacttgtggactggttggcagagggagggaaagctatgcagcatttttcgactttatttttaagagcagtcttaggttcacagcaaaattgaacagaatgtacagagaatcccaaataccccctgccctacacatgaatagccatccctgtgatccacatcccccacagaatagtaccaacttgtaacaatattaattgttacaactgataggcctacatggacacaaattatcgcctaaagtccatagtatacattaaaattcacccttggtgttgtacattcttgggtttgaacaaatgcataatgacttgtatccaccactatagtgacatacagagtaattcatgaaaaaaaatcatctatgttctacctatttattcttccctaagcccctacctcctgcaaccactgatcttttcactgtctccatagttttgccttttccagaatgtcatatagtggaatcatacagtatgtaaccttttcagattggcttctttcacttagaaatgtgcatttaggtccctcaatgtcttttcacggcttgatgtcacacttcctttttgcgttgaataatatctattgtctggatgtaccatcttttagggtatggctatggggagagttctgacctcagactattgcttgtcaagaaggtgacatggatttaactagcggaagagtgggtttatcaataaggcaatggtgaactgaacatgaaaccaagaagggtgatcaagctagagaaaaatcagtgaggctcctggagaatgaaccaggtcagagtgagtgatggttggggggaaaacggactgactcagtggatgtatagaatttcaatagtggagctgggggaagattggcacatgggatcatggagttgaaccatcattatgtccacgttaaatgctaactttggcaaaaataaaccattccatgagcttctccagccggagaaaacagcatgaataaagacacgtaggtggccaagacatggtgcgtatggacagccatatgcagatcgctttggttggagcatggggtgtttgtttttaaccctgactcttcctaactttgatgctaattttgagcaaatggaaatggcactaccacattcttggatctgtctggtatctggatttttgggttacactgcttgatttttttggcagtcctaggtcctcccttactgagaccactattgtactggcttccctggtggctgctccaggggcagggtgtctgagatgggctccttcaggcacactgtgtctccttctcaggacaaggacaagagcagcatctctgtagacatggtgctaagtcagcagaaggttctgattgtcagattcagcatttctcttcctgctggtttgaatgaatatctcacctgcagctgccttggaaaagctgtagtgtcagatgaggagggtcggaggtcagacagaggctgggctgttttgtgactcagattctttcgtttataacacgctggtaattccacttggggagcctttaatgctcgaactcggaggccttggtagagactaagttaatggatttgaaatttctttgaaaagcgaaattactggacaaacacaagatggtagtggttgttatagtaattatgataaaaatgaaggaaacttttaattttccagcctgatatgatttgaaggatgcaaaaattgaatctgatttggtcaagcattgatcttgcagaaaatgtcctgttttcctatagcaaagagatgtcctaaaatggccctgtaacttttgaattgagtccctagggaaccatggagttttagggtaattgtttgcaccttgaaggaacatttgattttcatgccccattgtttcccatcgcttcatgttcaatgccttggtgcaagttgttacctctgtctagaatgcacctccccacctaactggaatgtcagaaacagttcttcacttgtaagcaccagacacattctctggctagctaaagtgaaaaggaaaagagggggaactcacaaacttgagaggttgaggggactaggcaggactcgagggcatgctactcaaaattaaaaagcctgttggacacagcttgcatgttgcatctcactctcgatcaagcaagtgcatttaatagactcatcaagatggcggacaggaagagtgagattccccgagggcattgatggcagtagtggttgctatgcagccaaagaaattaacacatcctgtttcatcattgtttagtccccagctcaacagtcatctcctcgggaaactttctttacttcttctgggtagggtcattcaacatgcatgatattcaacagatatattagtatctacatgtgtcaggcatgttcagggcacaggttgcagccataaacaagatggacatgatctcaccatcaggaagtttacctttcagagaagcaagatgataaacagaatgaagaagcatatagttaattttaggtagtgttaagtactagacagggaaataaagcagggagaggtaagacgagagtgctgtggatggataaaggtggagtatttaagagaggctgagcaggaaaggtcttctgaggaggtgaggaagtgagccgtgtggagtataggcagcaggtgactgcaagtgtcagacgctgggtgggtaggggagggtgggcttgccatgtctggggaatagtaagaagactggatggctgcaggagagtgatcagataggaagtgggaggaaacaggttctgagaggtaggagagggcagctctcatgggacttggccatgaaaagactttaaaaacaaatagatcttaaatagacctggttttgtttttctcctgaaaacaggagataccaggtcaagaaggttcctctactctaacccttataaaaaataacctgaagcccttgttcccaccttataaaacccacgctatttcctagtgggatttgaaaccaaatagtgacagagtgatgccagtgcctaaagtttggtcagtctctcaactgagaggttgatcaaaagggggaattattaagtttagcgaaagctgcctctttacatactttaaaggtttctccataagtagtgaactgcaacctaactggtgtgtaaacagactgtaacccactgttgtccaaacaaccgagtttcagccaatcaaggggaccaactgttcaaactgggctcaagtagggcaaatgccaagctgtaatggatccagcttttctgcacctcgcttccattttctgtctgccactttccttctctgtccataaattttcttgtggtagaaatggagcctcttcacacctgttctggttcgagatctgtacaattcttgatcattctttgttcaattaaacacaattaaactttttaaaagagcagtttgggttttattcaactgtgatggaaaaccactggaggggtctgaacaaaggattgacctaactttattttgtctttaaaaaatactactctggatgctgcatggatagtaggagttctggagtgaggagggatagggggcaccagggaggccagttaggaggatattacaataatccaggtggagacggacaggatggttacttgggtgaggaggtactggtggaggtggtgaaactgaccagtttgggatgtgcttggaaagtggactgctctgtacttgctgatggatttgatgtgaggagtacagaaagaaaagaatgagagagaaagaatgattcttagggcttttatttaatcaactttaaatttgaggataattttagagttgtagaaaagttgcaaaattagtacagagaatttcatatatgcttcacccaggttgccccactgggcaaagtcctagagttctttcttaaattttaaaattgttaattattgtgcatacatagtaggtgtatatatttgttaggtatatgggatttttgacagaggcatgcaaatgtgctataatcatatcagggtaaatgtgatatccatcactcaagcatttgtcctttgtgtgacaaacaatccaattatactcttttacttacttaaaatatacaattaagttgttattaactacagtcactctcttgtgcattcaaataccatatctattcgttctttctattttttgaacccattaaccatccctattccctgccctcacaccccaataccctttccagcctctggtaaccattgcactactctctctgtctgtgggttcaacgttttcatttttagctcccacagatgggtgagaacatgtgaagtttgtctatctgtgtcggctttttccacttaacgtcatgacttccagttctatccatgttgttccaaatgacaggtcttattctttttatggctgattagtactccattgtgtatatataccacattttctttatcatctgttggtagacacttaggttgtttccaaattttggctattgtgaatagtgctgcataaacataggagtgcagatatctctttgatatactgatttcctttcttttggatatgtcctagcagtaggattgctgggtcatatgttagctttatttttagttagagttttaatatgtatagttaacgtgctggatggagttgacatttgttgagatggggaagacgcagagaaggggagatatctctagctctgctctggccatgtcagcaaatcatttcacattcaagtggagcagatatcaaacaggttggctagatctgtgaacacggagctcaggagagagcctgggtgtgggtgcagctgtcggcatttagatagtatttaaggtcacagaatgctccactctttttatttggtaattttcgtaataaaaaattcatttaaaatggagtcagtttaaggaaatatattaactgataacttaggtcatacttttctacaaatggccagtagaaaatgttttaggcttgcaggccataggatctgttgcaactactcaactctgccgttttagcacaaaaggagcctagataatgcatcaatgaatgggcatggctgggttataatgaaactctatgtacaaaactgggtggtggactggatttggctcacaggctgtagtttgccaattcctgggctctacatgttgagaggttgggaaggtgatgacaaaccatcaaggaggctgacagggagcaaccagagggtagcaagaaaaccagggcagtgggaagctcaggaaggcaagtccaggaaaggaatctccattatgtctgatgctggtaggacaaggaatgagaattgtcctgtggatttgacaaacagaggttgcaggatacctttcagtagcaccgtcgtggccacacctgaccagagttcgagaggaaagaatagcacagaagtaggcagggtggttatagccaactctctagatcattttgctataaaagggaacagagagaaatggagaattatctacagagggacacgaggtcacaaagggttttcatttctgtttttaaggtagaagctacgcttgtattttggggtgatcctctcatgattttgctatggttggaccctgtatacacttcttcttcttcttcttttttttttttttgagacagggcctcactgtgttacccaggctggagagcagcggtgcaatctcagctactgcaagctctgccctaccaggctcaagagatcctcccacctcaggctcctgagtagcggggccacaggtgtgtaccaccatgcctgcatgcctggctatttttttttttttttttttttttgtatttttagtagagacggtgtttcaccatgttgcccaagcctggtctcgaactctgagctcaaatgatctgcttacctcggcctcccaaagtgctgggattacagtacactttacaattaattctttcacattatcatttctttaaaatctgtgtcttcttttagcagggttctcagtctttgaacgtgacgttatgggccagacaattatttgctggggggagggcaaattgctgctcgttaagctcctagagtgtgggactagatttactcttcttgttctccctggctttaatactatgcctggcatacacagggggtgccataagtattttgctgagtgagttgtgaatagatgtgttcctttacaaagtactgttttgatcatctcataagaaagtcacatgtacctgggtggcctgagggaaaagcaaggcaggtctccagggttgagtttagcatgcctatctttgctgagattcaggatttccaattgcactggagaggattgtgtaggtagtagcagagggtggctacatttagctgacgtttctcatgcggcttctggactatcaaggtctcttcttcatgcctcctcatctgcttgggaatgttgcttatgtagtttctccaaaagcaagtgacatgagggatggggaagctctttatctcaagcatgattattacacgtggattccattattaggcaaatgctgtctacagacgctccaggagccacctcccaacacctgtctttcacccttgccagagactcaaagatgagtgggctttcagagtcataacaataataatattaatactgtcactctgaaatagacatggcaatttatactctgtgggggagtctttagtccctcatggctaagcacagtggaagggcacctgtatgtgaggtgatctcagtgggagatgaagatgtgaggaataggctaagtacctccctccccttgtaccaccctctgatgcaaacatgaccccacctttaggggattctataaaatgttgttgaatgggctgggcgtggtggctcatgcatgtgggaggccgaggtgggcggatcacctgaggtcaggagtttgagaccagcctggccacatggtaaaaccctgtgtctgctaaaaatataaaaattagtcgggcgtggtagcacacgctgtaatcccagctactcaggaggctgaggcaggagaattgcttgaacccgggaggtggggtcgcagtgagccgagatcgcaccactgcactccagtctgggcgacagagcgagactcatctcaaaaaaaaaatgttgaataaatggatgagtggatatgcatccgtgctcccatctgttcctgtcttccttttatttgtgtttctacctggcaccaagggtgtcctatagctgtcctgagtaagactgaattcataagaatttattaatttctctaaagagaggagactcagggcccagtaactgaatgctgttcttatttcagtctttcctgtatcaccttcctggattttgcatatcaaggtatcacctactttacggatctataaactatggcctgccacctgtctttgaaataaagttttattagaacagaattgcacccatctgtagatgtgctttctatgggtgcttcgtattacaacagcggagttaagcagttgctatggcgaccatatggctcacaaatccaaaacatttactatctggccctttacagaaaagcatgctggcccttgaagtacattatttttaatcaatttttctttaaattgactcagtttcagaataaacttattgctatggagatagcaaacatacaagaatagagagaatgtgtaatgaacactcatgtaccctcaattcagctcaactcatggtcaattttttttttttaaaaacagctccattgacatctaaataatattaaaactgcgtgtgtttaatatacataatttgatgagtttggatgtatgcatgtgcctgtaaaccatggccacaatcaaggtaatagatatatctttcacttcaacagtttccttgtgttctttgttttgtttttgttgttgttgtagtgagaacacctgagatgagatctctcttaaaacattttaagggcagaatacagtttgttaactatagacactatgttgtccagcagatcccagaacttattcatcctgcataactaaaactttattgaacagcagctccccatttcccatgcccccaacccttggcaaccaccattctattctctgcttctatgagtctattttagaatcctgtatgggtggaatcatgcagtttttgtcctctgtaatggtcttatttcacatagagaatggtccaggtttttccatgttactgcaaatagcggacttttttttcttttttttttaggttgaacaattttccattgtataaatatgtcacattttctttattcattcatctctttttttttttttttttttttttttgagacagggtcttgctctgtcgcccaggctggagtcagtggcacgatctcagctcactgcagtctccgcctcctgggtacaagcaattctcccactcagcctcctgagtagttgggattacaggggtgtgccaccacacctggctcatttttgacttttagtagagaccaggtttcaccatgttggccaggctccattcatctcttgatggaatttaggttatttccgtatcttggctgttctgaataatgctgcaatgaaacttctgcgagcaaaggaaacaatcaacagaatgaaaaggtatcctatagaatgggagaaaatatttgcaattatatatctgataaggggctaatatccaaaatatataagaaattcctatgactcagagtgaaaattattaaatggacaattaaaaaatggacaaaggacttgaaatatatgattctcaaagaagacatgcaaatggccaacaggcattaaaaaggttctcaacatcattaatcacagggagatgcaacacaaaaccacaacgagtgactgtgaaattatctcacacctgttagatggctattataaaaatgaccaaagataacaagtgttggcaaggatgtggggacattggacccttgtacactgttggtgctaatgtaaaataatgcagctgatatgaaaaacagtatgcggctcctcgaaaaatttttaaatttttattatcggttggtgcaaaagtaattgtggttttgcaattaaaagtaatagcaccagcgtaatggaactatcttatgatccagcaatcccattctgggtacatatcccaaagaattgaaatcaggatctcaaagaaatatctgtaccctctgttcactcatgttcattatggcattatccaagagagccatgttggggacaatcttattaaaaaaaaaatttttttttgagacagagtctcactctgttgcccaggctggaatacagtgcgtgatagtggctcactgtaacctccatctcctgagctcaagcaatcctcctgcctcacctccctagtagttggtactacaggtgtgtgccaccatgcctggctcatttttgtgttttctgtagagatggggtttcaccattttgcccaggctggtctcaaactcctgggctcaaggatccacttgccttggtctcccaaaatgctgagattaaaggcatgagccatcgcaccctcccaatcttgttttcttaatactccctcctccctaataccttaccaaccccctgattatttaatgcaaatctcagaacttatatcattttaatttaaagtttcagtaagtatattaaagaactcctgtattgactataaatacaattttattattcctcttaattaataattccttatatcatcaactatccttaaataactcaaggtttttaaacataaatacctacttaagcttatttcaagcaataatttgcttgaaattatggttcagatatgctatttatattttttaattagtagaatggctcctgaatttttgaaaatttaagaggaaaatgtatccctgcaccatcaaaatgatcttgtacaccatcagtataccacacactggaatacaccacgttaaggaggccttagcggaaggcgttgtccactttcttctttgaatggtatgaaaggtcttacagtgtcttgttttcacaacccagacagagttagtcagtgcctggagcaaacaccagcgacatgcaaccaaccatgaaatctgaaggaacaacaacttcatagtcatcttcaccagctcaacacatttatagtacaattaagaccggcaaatctaattggataaacagaaaatagaattaaggtatctatcctaagtataccaaattcctataatgagttgctttcagcagttgtggaaacattaattaccaaacaaattacatgttatttttatctaagaagctaattaagtgttctgtgtaattattatgtggtggcaccaggatcagagttgtattaaatacctaattggaaaagggagagacccgagaattttacatgggaatgtgactgagagagatcatagcaagagggtctgatcagagacagggacttgagagaagctaggtggaaatgggagagggttagggtgtctttgttggtttaaatttgtttgtgtttttagagacagagtcttgctctattgcccatactagatacagtggcatgatctcagctcactgcagccttgaactcctgggctcaagcaatcttcctcttcagcctcctgagtagcagagactatactcaccaccgcacaccaccatgcccgggtatttttaaatgttttgtagagacagggtcttgctgtgttgcccaggctggtcttgaactgtggccttgatcctcctgccttgacctcccaaagtgttgggattacaggcatgagccacatgcctggtcactttcgttggtttaacttgagcctggatggttgaggttaagtcagggcctgacgtgtatggagccttagtctttttaatttatctgttctttaaacttattcgtctcctaaatgtaagctgcaagtctctgtgtgctgcagctaaccttaaccctgggttttttgatgtgtgtgtgtgtgacccttatataacttccttactttgctctcatttcctcatttcccgtggctcagtaaatcttccaatatcttcttgtgggttcgtgctcttttgcaccctggaaggtaggacatgggcgctttgggatatttcctataactcagaacaggtagcctggaagaatttgcaatgaagctttgagctggcatcagcctcaagaaacatatccctgttgagtgtgaaggagaggcagaggcttctcctaagttgaggcaggtgaggattgaagttgctgcatttcaccaggttagacatagtgctgtggtggaaagcactctcagctggagtcataagaccagattattgtccctgtcctgctgttggtgagcagtgtgacctttggcaatgcatcattccctctgagctctggtatctcatttgtaaaatgtggaaaatagcccttggcctatttacctcaagaggtgccctgaggatggcatgccatagtgtaaatgaacatcatctgtaaaatctcaattttacaacagaaatatatgaaaaggtctggcattatggttgtttttaaccaatggcagtgtaggaagtcagacaaggtgggtgatgtaactgaaaagagcaggaatcttccagcctgctagatccaggtgtcatttggatttggtctctcctgcttttccccttgattcttctctgattcattgtgtttttattttattttatttcatttttttagatggagtctcgctctgttgccaggctggagtgcagcggcatgatctcggctcactgcaacctctgcctcccgggctcagcaatacttttgccttagcctcctgagtagctgggactacaggcacataccaccatgccggctatttttgtatttttattagagacagggtttcaccatatttgccacgttggtctcgactcctgacctcatgatccgcccaccttatcctcccaaagtgctgggattacaggagtggccactgtgcctggcctattttttatttttttgagacagtgtcttgctctgtctcctaaatggagtgcagtggcacgatctggctcactccagcctcaccctccggggttcaagcgatctcccacctcagcctcctgagtagcttggactacaggtgcataccaccatgcctggttgttatttttatttttgaagagatggggtctcactatgttgcccaggctggtctcaaactctgggctcaagcagtcctcccaccttggcctccaaaatttctgggattacaggcaggagcaccacacccagcctgtactgactttattcagggaatgtctccccaccccaactcccagttggcaagacagtcactagcagaagtgttgcatctttattctgtcagttaagtgacttagggaaacagagtgcagagtccacttcctggtcgcttcatcagaagtcccagggctaactcgattggactcctcttcctcacttgcccataaatcaaccaatcacattgttcaggataggatacactgactgaccaggctggtcatgtgcatatcctgagagctggagatgctgaagttccccacttgagctacatggaatgaaaagtggggacagttggttccccaaaagtgccagagaaagagtgttttctggactagagaaaaccaaagatctcattctcccataggctacctattgaattataatagaaaaatttactagattgagagtcagggaagacttggattctagtctgactgtgtcactatcactccgaccctggatgtgtcaactctctttttgggaacccagttccaaatctttgaaagagatttgggcctgaattcttctgaagttcctcaccttttcttcccagggactcttcttatcctgcggctttttatcgtcatggtatactgtgtgttttgccgcaaaacaaaatacattaattaagtactaatcgattttatttaaaaaaatgaattaacagatacaatcaattgccacttagaaatgcagatcaacagaacataaggtaaccagtggaacacactgagttatatatattccagcccaaagcaaataaacttaaatatttctttaatcttcctgtgttgcctgggacagcctgattacagggcagaatttgaattatgccaggccttataaatgttcagcagggctatagattcctatttctcatttactggatctcaggtgcctgtatcccagctactctggagactgaggcatgaggatcactttaacctgggaggcggaggttgagggagccaagattgcgccactgtgctccagcctgggggatagagtgagactcccttcaaaaaaaaaaattatttatctcatctctctgggttctgcacatatttgaatttgctgcactgatacagaccaaatcagtgtttcctaaacctctctgatattaaaaataacctgtgagcctttaaacttacaacctcttgggtattccccccaccccactttgattcagtatgtttggtaaggttgcatacttgcctttttaacaaggtatccccaggtgattcttatcgtaaagaagtctggaaacactggactaagtaacatccaaggccttactactctaagtgtgagcagcccatctgtatcccctgggatgtcttgtttaaattgcacaggccaaaccctacagacagacactggaatctggattttaacaatggaagcagattggcttttgtttttaattggcttttatttgatctattttctgttttcattgtaatgaggctttcagctgcccctcttgccctaggctcttcagaagagacatttccctctcctctccctgcctccccacagggtataataaacactgttggggtttggtggggaagctcaccctgacctcccatcactgagacacgaggtgcaaagtgttctgcacacagcctgagatcttgcctctcaaagcagacttgacccccaagcttcacccctaggtctcaggaagaaatggcctcagcagattccaggcctccagggctgtctgttcatgctctcaatttttacttggcttgatccgtgctgtctccatccggtgttctgaggatttcacacacgactggtcttcggcaactgggccaagcctgttctgttctttttcagtttcttaattgcaaggctttttgtttccccactggagaactcccataccaagaattctgaatctaggtactcagaccttagtggatgatgttctctcagcacttaattcactcatcattcataaactatcctcaagcaattctatattcaaaacattctgataatgatggcatagtaatatgataatgataatagttggcatgtattgaaattttattatgtgcaagaaactatgccagtactttaaatatctcatttaatcctcacagtaagtctgggatgctggcactattcttaccctgcttgacagatgggaaaactgaggctcatagaaggaaacagagtgcacagtgtcttgatatggtttggctctgcgtccccacccaaatctcatctcaaattgtaatccccacgttcagggaggggcctggtgggaggtgattggataacgggggcggattttccccttgctgtctcgtgatagtaagcgagttctcacgagatctgatggtttaaaagtgtgtgtcaattgctcttttctacccatccccatccttccgctgtgtgagatgttcctcgcttcctcttcgtctccaccatgattgtaagtttcctgaggtctccttccccagccatgccaagcggtgagtcattaaacctctgttccttataaattacccagtctcagatagttctttacattgtgaaaagaaccaatacagtctcacagttgaatagtgatcgaatgtggtttcaaactcagccctcttgacttctgagtcttcagtgttaaccatctcacacacttatatgatttaggcttgatggaacagcccacttttcatgaagcattatctacagagcctttaatttctactaatgccaagggaaagtgccatgcccaccttggtgatgacagaactagggtctaggagtggattcatatgtcagagtctcatggccagggattggtaaaatccaaatttggaatctggcttctggctaaagcccaaggttctttctgtcatcccagactgtacagcccattatctcaaggagctggccctcagaggcagagagatcatgttcagtatctaggagtttatgacaagtactatgtggtcatcccaggctctgaggataaagtcatgactcttgggtgagctcataatgcgggcttgcttgcttcagcccttactttgtgctaagcatgtcacactctctcatttaatgctcttaacctacaattacccccattttacagaggaggaaactatagtgtctcacacagaataggtgccagtgaatttttattgaaaagaagaaaaatggcacgtgagttgaattaaggaaatgtagccagggctggggcaggaaggcatacagtggccatacagccagctgacgggaataatcgatgcctgaatatggagtttgaacttcgtcctccgttttgtaagtagctaaggaagggaaagaaattgtccatagtgtgcaggaaggactggaggcaggtgaaagcattaggtcattgcaacctccaggtgtgggtgatatggctcaaactaagatggagaaaataggaacacctgtcacatgtgtagggggcaggaatgtgactttagagtcaggcctgctttcaatccagcctcctatttaagcaagttactttatcttctctgagcctcatttttgttctccttttaaatgaggtggtaccacctacttattagggttatgtagcatgtgctgttggggctttcccatatgccccagtccttgcctccatatactgaagcttgctcactgtgaacccctccgactctgtctttctggctttggaagcaggtttagcccacctgcagggggagtgaaggtgctggaagcagcaacggtagggatttgtggataagcactccagtcctttgtcttgtaggcaggataactgtatgtagagtagatatttcatgctatatcccagatgtctctagtgatcttaaggcccagtgccttaagcagtcacttaatttaaaatttaccatttattgtttccttttacttccctgttcacttctctttcctcttaccagtgtttcctgggatcatttctcaaaccactgggagctaaattctttttcagggcctcaggtcataataatgataaaacgaaacattgtatgttaaggcttagcacagtcgtgaggcccaaggtcagttccccgataaatggtagctgctataaactcatcatcattaccatccttgtgaaggtggagtgaacttattctttcaagacatttccatgacagataaattcatccaaaatatgaagaaaaatgggggaggaaaaggtcacctagaaatgcagagcaaaatattgcaatgatttctttttttaatgagatagtttattaattattatcagtatctttaacctttagtccttgtttaacaccatggataacaggtctacaattgagataattagccaaatgcctcttgcatcctaaattggctattctgagttacacagtttgatttcttggaaggaggacctggtttcattagcacctagttgcaaatgaatctcctccttgagttcttgttgctatttgagcttgtttttagctggagatttactcttggattttagttgtttcgccttcatctgttgaagaggtgggatgatattgcgtgtgtgtgtgtttgtgtgtgcggaagttatgcttccaatatttacaatattggctttccaaagcagaagatgatgggcttctgggagggtggttcaataggaaaccttcagaaccagtggggttggatggtggagcagatgtaaaagggagagtgatgaaaagtagagtgattgaaaggataagcgcatctgcttttaacttgctcacttaacttatatgtgcttatctggaccttggccccaggggaggagatagagaatgcgtgagaagctgtcttgagtgttagggacggagtatgatgaatgcaacaactgtagttctgtgtcaacttggatggggctacagtctgtactcagtcaaactctaatgtaggtggttgtgaaggtgttttgtaggtgtgattaaagcttataatcagttgactttaagggagttatcttagataatctgggtgggcctgattcaatcagtcagatgccttaagagtagagcgaggcttctctgaagagtaaattccacctgaggagagaaggtttagctcatgcccagaattccagcctgccctgtggatattggacttacctacccattccccacaatcatgtaagccattccttgtcatgtatttcttaatatatgtctcccgctcatctgttcctttaattgaacctcaataatacagattttggtgccaagaatagggctctgttgtaacaaataccttaaaagtggcagtggtcttggaattgtgtgttgggcagaggctagaataatttggagacacatcgagaaaaagactagacatccttcaacagactgtgagtggaaatacgaatgctaacagtttgtttctggggactcagaagtaagaaacatgttagagaaggcatacatcattttagagatacctaaatcatcatgaacagacttttggtggaaatatggacgttaaaagcattaccaggagggctacctacgaaggaaatgttattgaaaactggaggaaaggacatccttgttataagtggcagagcatttatctgaattatatgctacagttgtgtggaaatctgaacttgcaacaatgaacttggtaaagtgttgaaggggcagcctggtttcttcttgctccttttagtaaatgtgagaggaaagagattgaagcaagaactgttaagcaaaaagcaagcaagatttgatacttgggaaattctcagcctatctggattgcaaaagatgctaaaattaggagatttacttcaggaaagcatgttaggaaagggtatggctgaacagttttttttgctagttcgttggaagataaaaagtcccagtattcagccacacagagtgctctttgaagagattaggtatgagctcatgtaccccttggccatcaaatcagaagcaaagaatagatattaggattatctaggaagaactgtgaagaaccattttttgtctgatggagtgaatccccatgacatactcaggaacccataaggtttttgaaatttcctaccagcataaacattggcaatttggacagaagggacagagaagataaaatgaaggaaggccattacactccctaaattctttttttattattatatactcgaagttctagggtacatgtgcacaatgtgcaggtttgttacataggtatacagtcccctgttggtttgctgcacccatcaactcatcatttacattaagtatttctcctaagctatccctcccccagccccctaccccctgacaggccccggtgtgtgatattccccgcctctgtccaagtgttctcattgttcaattatcacctatgatatactccccaaattctacagcaggaaatgacggttaaaactcttaggctggaaacacatattacccttcatgagaaagactggttactcagagggtagagcctcaagctcaaaggacagagatgggagaggattattctaggctttgaagcctaatgtttgcctaactgaatctctcctctccttttttttttttttttttttctggaaacagtgtctcaccctgaaggccagactggagtgtggtgatgtgatcctcactgcaccttcgacttcctggtctcaagtgattctcccacctcagcctcctgagtagttggactacaggcatgcaccaccatacccagctaatctgtttttgtattttttttttctttttagaggtggggtttcaccacgttgtccaggttggtctccaatgtctgggctcaagattccaaccaccttggcctcccatagtgttaggattacagggattagccactgcatccgactgcctaactgaattccaaaattgtttggatgtggtaacttgttttttcttttcattgttccttttttgatcaaaaacccctgtaactgatatcccatgcctgttccacaattgcattggggagcagataatccgttttctagttttacaggtccacagttggagagaaactttgaccaggagggatcatgctcagattcttataagtacttgacttaggtgattgagataagatttagacatctgagctcatgagatttatttatttatttataattattattttttttgagatgaatctcactctgtcaacccaggctggagtgcagtggcatgatattggctcactgcaactccacctcccgggttcaagcgcttctcgtgcctcagccttcagagtagctgggattatggtgcacagcaccgtgcctggctaatttttgtatttttagtagagactggtttcatcatttggccaggctggtctcgaactcctgacctcaggtgatccacccgccttggcctcccaaatgctgggattacaggcatgagtcactgtgcctggtctgatgagattttgatgaaaatttggactttgacactatcgtgagttagttttggggagatggagtgaatctttgggagcaaatggtggcctggcaggcagaactacgacctctcaaagatgttcaccttctaaactctgatcctgtataaatgttatgatttatggcaaaagggattttgaagatgtgattaagttatgatccgtcttgagatgagagcctcatccaaaattatctggtgggcccaatataattgtgatgtacttataagaggcgggcatggaagagtcagagaaggagatgtgaccatggaaacaggttagagtgatgtggccatgagctaaggaatgtgggcagactctacaaactggaaaaggaagaaatggattctcctctaaagccttagaaggaagcactaggaaggcctgctggtccatttaggtttctgacctccaggactttaatacattttacatcactctaagccactaacttatggcaatttgttacagcagcaatgggaaacttataatctgttaagtgccaggtcttctctacactgcttagacgtattattttgcttctttctgcagtcctttaggacatacgtactaattcccattttgtggttgtggaaaccgaggcaatgaaagttcagatagcttgcttaaatgacagatctagttagtggtggctctgggatttaaccccatgcccgaatgattccaatgctatggactagctcttgcatgataaatgtcaagggacatgaggagttaggtcagaaagcatcacgacatagctcaatgtgtggctttacatttgacgtaggatgacctagtggtaagtgtatagcacctgtttaggtgcactggagacatgttgcatggccccaaatccagctttgcacccattactggctgagtttactttggacaagttatttcacatctttttttttttttttttgagacggtgtcttgttctgctcattctgttgcccaggctggagtgcagtggcacaattcagctcgctgcaacctctgcctcccgggttcaagcgattctcctgcctcaggttcctggtagctaggattacaggcatgcaccaccacgcccggctaatttttgtatttttagaagaatgggatttcactatgttggccaggctggccttgaattcctgacttcaagtgatctgccgcctgagtctcccaaagtgctgggattacaggcgcgagccaccaagcccagactatttccatctctgaacctcagtttccttacttataaatggggattataatacttttttttagggtatggagcttagaggagaataatggtggtaaaatgcttagtgcagtgcctgacacatcaaagcgctcataagtaaaataataacagtagtagtaataataacaataataacatgctaaaataatggcgaattactcttcctgttttgccactctaggcagagggatattagtgaagaaatacaagatccatggtgggtcaggggcacaagtgtgttacaagcaaaaagaacagcagcactcaggccattgcctatgaaatgttcttccccacctcttaaactggctaatcccattaaaagccatgtctcccaggaagtcttccctgaccttcttggctgaaacagacgcccttttctgagggcctatcacagaaggtactttcctactctagtcttgtcaatgcatttgaagctctctcagtagcctggaaactccgagagcagaggtgctctctgtccctctcttatttatgttataccctgagcattaaaaaaaaaaaaaatgggataagtggtgagaagagactggagggcaggccttggccatgctaggagggaccctttagcttccaacttcccgatgaatttcccccgagttggtttgctttgtctttgtaactgagaacagcctagggagaagcatggacatggggacctgcaggcatgagactggttgcttagcatctccatggcccctcactactacagccactctacatgctgttctgggcctcattaaaacctgttctccactagcctcggtgtttatatttatcgatcacccacagcatgcaagctggtcaataagtgttttcagaagcctcacccatgccatcttgatcagcccctgccgctattttccatcatgccagctcttgaaatctttggatgtgccttgaattttttaagtgcttttctaacaaaagtcccgactgcagagatgcgaagcttaagttccatttcatttgcctcctgaaccttgagggcactggtttttatattgtgcctctgtccctcttagtcctcagtccccacacttctcaggatagctgaagagatgagctgtgtttggctctgagttccagctccctggcagctatggattatatgttagcacaatcattttactcccccagctgtttactttcctggggacctgcttgagtcaggctgctcccgactcccttaatgaagacatgacagtgggtggctggagacgagaagttgcaggagaagcgaaaggagagagagagtcccctgggttatatccctgttactcaacattgttgaattagatctcaacattccatcatgtgatgtttggatgctgggaggggagttaaatatagaattcctcttttggcatttcagaaggtttatataatgtcctgttccttttgacagtggggagaaagtaataggatggcttggaagatgggtctgtgtccggagctccatttaaagtctactcagcacctgacccatctgcctactcaggggatgttcggtgaatcatgtttgcaaaggcacagatcccttttgagcccaaagatctgctcagctcgaaaattctattaattctaagattctacagtagccttcacaagagtggatgctgaaaatagatcagccacgtggtatgccctgaatttcctggattactgatttgattttcccctcaatgtttccctgaacctggcctggaaattcacttgctttaccatttgaaccctgccgtggagtcccagggaccagcgttccaagtctgccctatcatttcccagccatgtaaccttgaatgagtctcttggcttttctgagtctcattgctttagcatgtccccatacctatctctccttcttactttcttgtcttagtaaatgacctattttccatctagctgttcaaactacaaacctacaagtcacctttgatttctctctccccttacctgctatgtagaaaccatcagcaagggcttctagctctgcccttaacacagatcatgaaacatgcttctaccttcactgcaactccttatgaaatctgcattcagtgacagcacatcttctaaactggtatcttcttccagctttgacatcctatgatcaatgcatgacctcctggtcgagtgagtaagaacgatgacaaaacccatatcttgaatcacatgcatctttataaaatcttcctccagctttccattttacctagaattaaaatcaattgcttgctgtggccagaaggagcaccataatctcctgcttatatctcagaccaaatcctgctctcttttccctggtcctttatctttctggaacattcctcacactcacctttgcacgtgttgttccgtttgttgggaatttcttcccctggacctttctgtggttgtcttgttctcaccattcaagtttctctcaaacattgctgactgtgacaggctgttcatgatcatccaagttcaagtagcctccctctagccattagcccattactcagcttcattttctcctatagcttagctctatctaagattatatggttagtgttttgttttttttaatcaaactcctcccattaaagcatgtgtccttgaaagcagggacattagtcatttctatatcttaagagagttatcaccagcctgggcacacagagagactttgtctctactaaaaactaaaatgacttcaccaggtgtcatggcttaacctgcagtcccagctacataggaagctgaggtaggacgatcacttgagcccagaaattgaggctgcagtgagctctgatcgtgccactgcattccagcctgggcaacagagcgagacctgttttaaaaaagtaagtcacgcacgtagtaggtgcttaaaaaaaaaagtgatgcacaagtaggtgcttaataaatatctgttaaatgaataaagattggttacggggatgaaataaagcgtgctcaggtatgcacagacacactcatgcacatatgtgcattgaaactgccatggaagaaatactattgttaatagctgggagccagaatttctatgactctccagttgcatcagcctcccttgactgtattatgctcctaagaaacttttcttgccttttgttgaattaaaatctttaacttctcagctatctcatggatctttgcatctgttttgcatctgtttcttagcgcctagcttggcgcatggtgctttatagagacatttagcatgtaaagatatttataaagagggattctcttctatttttgcccagtcatctgttggagagagggggagcagcaagcagcacacatgattcatgctcttgcctggagggtgctgcccacctctagcctagaagagtgggtggcaggagccctctgcattccaaggctggttccagtgaatggagcatctacagtggtgtttggccaatctcaacattctgtaatggcctcttctttacagttcacacttcccagatggttaatattacagctccttccatcagaatgtccttaagtgtgtagctgcaaagttgagggtacagttcataaaacgatcatttctgacatcacttggaagattgagggctgccaagacacccttatctttgataattcactggaaactcacaaaactcgctgcaagctgttgcaccacggctatggcttgttatagctgaaggatacagactaaaatcagccaaaagagggacactaggcagaatcatgaaaggtccaaccgtgagctgccagtggtgatcttcctacggaatctggacagtgccaccttctcagcaacaacggatgaaaataagcatgggacgttgccaacagggaagctcactgagccttggcgtgcagagtcttttttggggtctgctgttgagttctttatgggtgaccttggcttccaggtcctctggaggttgagctcatgctatgtgattctaacccccactctaaatcacactgttagactctctggtgtgacccaaggcccccacaagcaaaaaacactcctatccaggcatgacattcccagggcttagtaagacaccaagggtaaagacagacttctttttgggcgaggtttaattctttactatggaagagctcaacttgatactctggtatggatgacttacgtagatagcggtggtgctggcccttttcttgcttccagtgccgaattcatccatcaattccacaaatatttattgattgtgagctaggtgccaggctctgtctagttgctagggatacagtggtgaaggacatagttcatgctataaaaaggctggggagcagataaacaggcaattattcttatatataaatataccatgatgctagaaatgatactaaggctcttggtgcacaagggtgcctggcacagttgctggtgaagacttcccagggcggtgtagttaggctaagattggaaaaatgattagaagttggccaaccagggtggagtatggggtagggaggtagtgtttaggtggaggaatatcacatgcagaggttgagtggtgagaaagtcttgaggatggtaaggagctccacattttcatggatgccacagctcacaggtgattcacttgaacatacagccaataaacacccaaagactttcccatcttgtaccaaggcaggtggtttttttttttttcaagactgaatctctgttgccaggctggagtgcagtggcacgatcttgctcactgcaatctctacctcccaggttcaagcgtttctcccaaggcaagtggattttaaatcaagaaaatggggttcatgagagaaattcttggcccctgttgctgtcaggaaggctttagactaaaaagaatggagctaatgaaagcagttggatagggcaagcgtatgagcatggctttcactggcttagggcagctccaactcccccagaaaaggctctttgtttatggtgggtcaggacttcagagtgtgactcagaaggtcctcagagctggtaaaaagtgtagactgtgctgtaggccaaaagacaaggtttataaaagcagaaggatttctgagacatcttggactgtgagcaggtgactcacagacgttctagaaaccatatttcaaagacaatatttttggcgaatcaaatggttgctttgtggtcgtttcagggagttccagcaataacataaagaaaataacagaaaccaacaaatggtagggaaaaacgttggtgatacgtgccaaagggttactattttaacgcacaaagatgacttacaaattaagaaaaagacaaaacaccctaaaagaaaaaggaagagaaatgagtaacatgtgattagagaataaaaactcaatggctaatagatgcccagaaaatagtaaaccctgccaatactgcaaaatatttgaaatacggtaatgaaactggcgggcactggctcttgcctctatttctagtgctttgggaggcagtggcaggagtgttgctgaggccaggagtttgagaccagtctgggtaacatagcgagacccccctctctacaaaaataatttttttaaatgagccaggtgtggtggtgcacgcctgtagtctgtttcttggaagctgaggcaggaggatcacttgagcctaggaatttgaggctgcagtgagctctgattgtgcactgcattccagcctgggcgacagagcgagatcctatctcaaaaaaaaaaaatatatattataaagaaatccatcaactcacacaaaaatgttgttgatgggactttgcattattctttaattaagaaaagcaaaatgaaaattcagtaagcaaaacagtgcagttggaaggagctcaagcctccctacttcattctggtgaaggcagggagtcaggaaggagtctggggctcctctgtctgtgtcctcattttgtctcccacctcctggcccccagttttcctgcaggtgtgaggtgtcagacctccttctgctctgagtgggagagaactcgctgtactctagggagctgagttggggaaagactggcccttaagcatcctcccacccagcctttacccccagctctctctcctgtaggacgcctgattttcttggcagaggaagaagctaccctccatccactttcccaggtaggcaaggcagcctcttcccctgggccatccagcctcctgtaggcctggggcttagaaaacagccagggagggggagactcggaacagtctttttttttttttttttcctcccacatgagcagtatgaggatgatgccttagctccattgctttgctctcagccttcagacttgtgtaggagaatctctgctgtaccctgtcatgtcttagatttgtgtaattgagggaggcccccaggcaatttaagtagggatttacttattccttgggagtgctgagcttgtagtggagaatggtctactcactagtgtatttactcgacttctcctaacaagggtctttccacttgggttgttctgtccagcatcccttgggacttccagggaaagccaaatattctttgctgccctgcttcttcgacaataaatgcaaaaagtttgaaaaaatcccgtactggtgttgtgtcacagggtcaaagaccttgaatctctagtaagaagtagaaggcgtcaagaggtcaagttctgctccatagtttcaggacattgtgggacttgattgctgcagtgtgaaatttatggttttgaagacagatttaaaaccctttcatggcatcttgtagcctttggaataaaatccaacatctcaccatggcctatgaagagaccctgcatgatttgggcactaggtgcttttttggggcttgtttgctgtcattttcctccttgttctttccaaccctaggggctttgtcctcatggttcctatgcctggaatgctcttcccactattctgcactggttgacgatgacttcttcacaattggcttttggggcatttcctttgagagggcttcgtgacagtcctgctaaccttttccaaggagccctcatgtcattagctgtaccacaactttaacttgtatgtgttcatttacatgttctgtctcttctgtgaaatggttgctccttgagagtggggcctctgctctgtcttgtaaacacctgacacacgggccaacttataaatatcatgaatgaatgaatgaatggatagcttctagttatcaattgtgactgtatctttccctgccatctcccagctccgtctcacctggccacctggaaaaacctcttgtaccccataatttcagtgcccctgtctgtatctgaggcttggaaaagctctctacccaagcaccaaggaatcctgcccttttccgcttgcccggataacaaagagttatcaaggctaagttgccagttatgttggcttcttctcctgtttgctcttggaggataggattttgattacaagcataacagcctccagttattgagcatctactgcataagggcaggcactttgcatacatgatccctgatcttcatagtatccctacatggtaggtttattatcccaatgttgtaagtaagcaaacgaaggatctcacaggtcagtttgctccctggccacctgacctgtgctcttttttccctatacatcgtggcctaggttttggaacacacagggcacgcacacggcccttctcagactatgacaatatagtgcactgcaagacctcgctttttaacaacctaagctgatgggttgagttgtgagagtcagaagcttgcaatttcacttctctgtctctggagactattctggctttctactgcctggaaagaaggtgggaacaagggcctgtgagggatgattacaccagggcagaaacagctcacctcttgagtgctcatgtgccaacactgtgccgagtgatttatacatatagctttctgtaacccacggagcagctctattttactgttattttgagcactattctgcaaatgtggaagctgaggcacacagtaagaaaggtaaacagtggaggctggatgcaaacccaggtagtctgattacagagtttgaaagctcagcaccaggtacctaccaaccagctaaacagatctcatcattcaaagtgtggtccatgcacagcagctttgacatcctctgggagcctgaatgtagaatctcaggtcccatccagactgacgagctagaatctgcctcttaacaagatccctcggcgattcacgtgcatgttaaagtttagaagaactgccccagaaattctatgaatataaagtaagtgccattttcctgaagtcaaagctggagatttagagcatcagtgttcttagaaacaacgtgcgacttcagtatcttgcaactatggcatcaacgaggagctgttcctttgcttgagggaattagtgatgacaaatgaattagtattttcaacaaaaataaaagcaagttgagcttgcatagttgatccaaggctttaaaaaaagaggctgcttcagcctgcaggatgttgttgacatagtattacatctaagtacgagggagccccgagccagggttgctggagtgtccctattgcaagtgaagttttggcaaaccaatctagggattgaaaaggtaactccttcattagatctgcctggaatttacacatctgaaatgtgagaggacaaaaaggacttttgatccaagagagatcggccccatctccctgtgtgggaaaaaactttgattttcttctttgatgtgaaacattgccattgctagctatatattgatcatagtcactggacaacttattcagctctagttctttattaggtcctcatggctgtttcttagacatcggaatccttaaaaaagagaattttattttattttttaacctttcccgcttataaatgccccagggacctggaaatgtccacgtgggctttaccaatgatgtatgtgttctgtttgagtcaaaataatgagtggttgcatagacgatgattgatattgtgtatttcgagtcgcctcattttggggaaggaatatgctgatcgtgcgtcaatttccctcaggttgctctccagcagggggcccaagaaggtctgcacccttttcatgtttctttgctgcttccttcatcttgccaagttacatttagcaggatattcatctaattccttttttaaaattttaagctccccatttttttggggggtgggggacaaaaagagccttttaggaaataagcatcagaactaactaatcaaagtgaaactttctgggagacatctgacagccgcatgcctctaatgccttcaaaaagatcacgtgctccaggcaattacaggatttgggagaaaatagctcattcgaatagccgaacctgctgcaatgttcatcactttgcagccgtgcccctacctccccgctttgtagcttccttaccccgaagcctcctgaaagagagttcacttggattaaaactcctcagctttaacaaactgcaaaggggacagctgatgctaaaaaaggggatcttgtgcacagtccaggtttctcctgtagccagagtttttttggctctggctacagaaggtgcctaatacatctgactcatggccaaatattatcaggggactttgttggtcaagctcttgaatatgggtcagctggaaaaataacctatttgtcaataggttaccagtttcacagctggtagtgcccaaagggcgctgaataaacttcagtgggatccctgctgcttggtgcttgaagttcatctgagtgaagcctttgtgaaaagagtattcaggaacccagtagcaatcttttcctttattttattagacaatgcttctctcttgtttgcagggttttttgagattttatgcaaacttttaattttttgcctgtcagtgtttccattatttgaaatctttcatattaagtaaaattagccacgccagtgctatattaaagtatcaaaacttttagcatttgctcaccctcctttcctgggggaacaggtttctctacacgattgcctgtatgctttgctatgagtcatagtttagagaaacccccacgttcctgtgcaatgaaagaagcagcataatgatctcaactcaggcagaatggctggaaagtcacgatatgtggctgcacccagtcggtacctttgctttgcttgtgttggagtctcttgcattagtgttgtgaaaatagatgatgagctcgtgcctctgtgactttgtttttgagacctgcctgatttccatggtcacaagaacacagagaaagatgtgtgggctcccggggctctgcctgacactgttgagagcgattccagaggagaaggtatctgtggggtaatcttggatgttattctgaaaagccccaacatcttcctcataacagcttctaagcttgaggacaagagttatcctctaaaaaggtgtccccaaacaaggtaggtgactttcccccagtattccaggggtgtgagccaagacatggggcaaaatgattaggggacctcctgggtcttggaatggtttaatccttcctgtagctcaatgtagctgtctgtggttgatgtcactcggagtcagggtaggagtgtgtgtgatacagtgtagcagagatgccaatctttgtggttgccccgccttcttgctgtggattgctgctttgaccaagagtgttggaccgatgaaagtatatccagtctcagtctgaaatttgacgtctgtggctgggtttgaaaggatgagcttgaatgtgggctttgaattagaaatagaataggatttttcagttagcatcgtggatacaggggctgaaaagtgccacaatgagctgaagttaggaaggaacaggggacagctgtgggaggaggacagtgtgggatgactggaggggagtggaaataggggaccatggggcaggggagtggggagagaattgaaggcttctggtagcaatctgcatgtgtccttacaataaacagtttctcttgaactactggagtgggtctctttccttgaccatgcggaagacctaatataagaaaggaaacaaaggattgcaggtgtcttccagagagaagatctgttttcctgtgtgttttaatgtggagtcttttctggtctgcttacccactccttgccccctgcatccaccccccttgtatatttttccttaatgaaaagaaaatagagatcattttaatacagaggtaaaattctagggcctccccaaaaactgtttcatgaatgaggaagctaagaaaaagggccactggctttaaagcccagtagttaaataggagaacggagaaagttataaaatgattaattggtcaagttgggatgggaacttaggttataatatcaagatttaaccttggcactatggacattttgagcaggagaatttttgctgtgggaggggctgttctgtgcattgtaagatatatagcaacatccctggactcacccactaaatgcaggtagcagtccatagttgtgacaacaaatgtctccagccatagacaacatttcctggtggtaaaaatctcccccagttgaatgtaaatttgttcagccattgtgaaagcagtgtgatgattcctaaaagaacttaaaacagaattatcaatcaacccagcagttcattatggagtatatccccaaaggaatataaataattatataaagatatatgcatacaatgtattctgcagccctattcacaatagcaaatacatggaatccacctaaacgcccatcgtggtagactggataaagaaaatctggtacatatacagcatggagtactacacagccataaaagaatgaactcatgtacttcacagcaacatggatggagccagaggccagtatccttgcaaactaacgcaggaacagaaaaccaaatactacatgttcttacttataagtgggagcaaacagtgcgaacacagggacatagggaggggaacaacagacaaatagttctaatcgaggcggagggtgggaggagggagaggataaaaaactacctgtcaggtactatgtgcatattcctgtgtgacaaaataatctgtaccaaatgtgggtaccaaatccctgtgacacacagttacctatataacctgcacatgtacccctgaacctaaaatgaaagttaaaaaataatctttcctgttgagaaccatggggctagacaaaaagccgccttccttcctttcttgaatgaagctttgtttgtttgaatctgctgtttatgaagggctgtggaggctacagagatgactaaggacagtctcttacctgtatgaattaacagatttctggaaaatattaagctgatatttattatcaatttattcatcaaataaagctggaaaataccttcctcttggctttgagtaacagcaagatatccacctgtgtcaaatgggtaacgctcattctaagtgtaatgaggatctaaccgaggttcccacccaacttgattactttataactttctccatcttcctcctcctactgaatctgctgggttttaaagccaatgggctttttttcccttagcttcgtaattcaaaggatatggtagatgctataacaaataagccctcaaatatcagtggtataacatagtagaagtttcttcctgctgatgtaatggtgttcctggttggtgaacagctttcctatggccatgcagtattcagggacctagatttctgccatattgtggctcttccagtcccctaaatctcactgtttttctttccaatcagcagaaaaataagtgaggagaaaacacgcccctttcttaagagtctggcctgaatgtgactttgtttatgctgatcttccattagaaaggacaattggactacgatgatttccgatcaagtagaataaatcaatattgaatggctcatcttggctaaaattcgtgacagtctctggttatgaaaatttaccatcaggatcctgttcacataggacactttatcagcagtggggagagtttagcagaattctctttctgcacagtttaagatggagctgggaaagaacccaagtttttagatacagcagtctgtctgctacttgaatcttttcttctccgcataccaggactggaagacatagattgtgcccaatttctatatcctaattacctaccagggattgggcatgtaaaatattttcagaggggatgaatggatgagaaatattgttcacagcttagaggtatacactcaaggaagattttacttgttaacctgaaaattgcaaaacaggtcttgtagagctgtacccacagcagtacattgatgtcgcaagtatcggggcgggaaaaacacaattgctgcgtggggtggggtgggggtgaccatagttccctttattagccagagataaagtgacaggagtctaaatgagaacctgaagccaaacaggaacatttatttgatcaggtactaaaaagttcagggtatctggcttccagcacggctgaatacagatatataacaatgtttcgagaacgtcttcctgtacctgggctccgctttcctctgtcagactcagtctttggcgattctccttaagtgatggcaaagataacaccagccacaacagatgttcatccttcaactggccacctcagaaggaagaggggctccagagaatgccccaagattatcattggctggtcagtgccatgtgctcatctctgcacccatcaccagggtctccctctcattgttcagaccagtcacttgtgcaccattagcacaaggggtgcccagtccacagggataaaggggcaagcgggacaattcttcagtaaaaaactagaatggatgcttgatgaggaaagatattctatgtcactatatttctattgtcattatggaatgaacctgtgtattttttatcttaacactcattccattcttctggtaattgtatgtaatcaatctctgttaagccctctccccagctgtagccctgagctttttgtagagattcctcctggtgcagagatggagcatatggttcagtgctgaacaatgtggtcattatatgctcctggtccctgtgaacagttcggggatggttatctgtccaggaagacccagtgaggtgaaatgagactttacctcaaacttgagtaaaagagattttttttcaaaattaactttttattatgatgattttccaaaatgcatgaaaatagaggtactctaatcataagcagagataactctcctatactcaccatccagcttcagcatttatcactcatggacaatcttaattcattttattgccacccacagtagattattttggagcaaatcccaacatcctatcatttcatctctatacttttcaatatgcgtctctaaagataagagccctgggggaaaagacttggtattttctattaaaagtgaacctgaaaagatgtagggaataaatcactgctaccatcttgcttccacttggagccaacaattggagccaacaactagagcaactgtgtggcagcagaacagcaagaaggaggaacacgaaatccagatgacagattttggtcctgaattcacctgtgcatggagtaagcttagctactttttttttttttttcagtccttgagctagaatattccctgtagctatgttgttgatgccccactcatatcctcttggccaccctgagggtcacctgaagcttagatggacagttcccaacacagtgatggcttctcactcaagcacaggcatctctctgcctaagaatgttctctggccatacgattgtgtttggccctgcatatggcagacctgaagtggcaggggataaataaatgccccccagaactgtcttaatgatgagggatagaagttggcataccctggcttctttgctgctcagggagacagtaagaggtgtgtcctacactgttattggagggcccttgtggggttaaatccctgttatccccgaagtaaccttcccatgaatttccctgctgctggcttcttttcctttcctgtcttattttctacttcctcaccacacttcctgtgatcacctcccaactaaaccatgtccccccagttcttgctttagcatctgctctaaagtaaaacttaactgaagtaattcccctttgcttcatttgcttaagcttccatggttctatttcctttttaaaaatttctatttaattttaagttcgggatacatgtacagaacataggtttgttacctaggtagacatttgccataatggattgtgcacctctcaacctatcacctaggtattaagccccatatgcattagctatttatcctgtgctctcccttccccaccaccaacagactctggtgtgtgttcccctccctgtgtccatggttctcattgttcagctctcacttatgagtgagaacatgtggtttttggttttctgttctgtgttggtttgttgaggatgatggcttccagcttcatccatgtccctgcaaaggacgtatctcattcctttttatggctggatagtattccataatatgtatgtaccacattttcttatccagtctatcattgatgggcatttgggttaattccatgtctttgctattgtggataggctaaaataaacatacgtgtgcatgtatctttatgacggaatggtttatattcctttaatatataccctgtaacgggattgctgggtcaaatggtatttctggttctagatcttagaaaatcactacactgtcttccacaatggttgaactaatttacattcccaccaaaagtgttctggttctatttctggtcattcttaaaacaaaaaaaaagtcctgagtaattatgctccattttccatccccagtatttgcttgagaaatgaaataatgaaggcttctgagaaacagtgtcccacgcccccataccccattcacacaaaatgttttcagcttgagaatacagttgcggagccaagttgggtctcaggaatatctggtttgcactaaatttcacctgcagaattataaattcaggtgctgttgccttgggcacaactgctgggctctgataagtagagtgggtgtcccgcagcctgtcctgttggttcagataatgatttatgggggggcgcaggccccagggtgtgacatggatggatgctctgcttatcctcctccagataggtttctggcatctaagacaagaaggagtggggtcaacaaggagagcttctgtctcttcctgtttaagcatctctcctactactacaaatgaaaacatacaaatactatgttgatggtatagcaagtaactttaaagaaggccccagaaatacttcactaattggagaccagttctccagcattttgaaaccataaggaattacaaagtaagctgaaaaaaaaaaacttagatcatgcaaaagagtggtcaacaaagtcatgtattctacacaaaggagagccgtcttaagactgtctctccaggctagtttacttttctttatacacaattgcaacagagcattgaaagcagcacattttaagcagggaaggaacagcacagcaagggctgcaaactcaaaaaattaaatgaaccagagaataattttaaacaaggaaagaggccagttgatggattaatgccatgtggggacgtgggtccagtgttgacagttttccatgttttcaggaagaaactgaaaattggaattttaagtgaaataaccttagttttcatagaaaatatctaaacaaaaaatttttaaaacagcatgcagacctggcacatcggggcgtgactttgccccattaaatgaagcataaattctctattttgccagtgttcctatttgctcatataggacactttaatttgtgattctttggttattagatcactagctttttaagccaggctttgggctctgtttgccttcttgggaaatactgtcagaaatcagtgggttcataccttttgaagaagtcactcttattttggttgagtgggcagtgttcttagctacccaaaaaaactagctattcacttcctgggatcgctgggaccggtgcctgcgggtttctggggacaagaagatacatcttcctcctccctctcctgtgtttacacaatctgctttgaaaggttatattcttctgtgggcgactggcctacagcatctgcctgctttgcttgatttggttcatttacccaggctggcatcttcgagtctggggtccttttggctttacccgcacataatctcttggtggatcaaaacctcttcaactctctcttgagtttccaagcaggctcccctgtggggctttctaagagtgtttagcattggcattgctgcagagcacagtctcactgtgtggttttagaaggatttgttttttaaaatttattttctatttttgtgtctttagaggcagggtcttgtctgttgcccaggctggagtgcagtggcatgatcatagctcactgcagcgttgaactcagctcaggcaatttttcttgcctcagcctccagagtagctggcactacaggcacacaccacatgcatggctaattaaatctttttttttcttttttttttaagaacgagggtctttgtttccaggttggtcttgaactctgccctagccttctgagtagctgggattacatgtgtgagcaccatgcccaactaaggttaaaaatcttaagatgcccttcaagactctactcctcaagtcatgaaatagtcttttaaatttgttaaaaataatgctgagtgtattttattttcaactaataacgctgtcacacatattaaacaataatggcattttcccatttatttccttctgcaatatatgtgtgcattgatgtgcatgtgtatgtatgtatctgtatttatacaagtacatagatataaatatatccatacctatttgtaattgcacacaatttatacatgcagtagtgtaaagctgcatgtttcacttactatcaaaatctctgtaagcataatttttatttattctgatatttaatacacagtgatgtaactgtgatcccaaaatgtgcaaagttaaagccttcaacgcagctgaggagagggcaggaatggtatatggggacggtggtgagtcacgaatgatgggaggcggccatgagcagggcagcctcctccccggggccagggacaggggaatggcctaagagccaggacccaagggtagcccaggaccggggaagggggcagagacctccccttggcctggtcaggagctcagaagtgccacatggctgagggggcagcggcccgggaagagccagagcagagccaggaaagcaccatttcctgggggggctgggggcagggaggtaccctacaggaaagccaggtggggcctcctgtccctggggtgggggccatgctggagcatgctgcagcaaaaagacctgaggcaggcgcagggcctgagagcctggctggctgggctggggggcgccccaggcagcctggcccagggagcaggcccgactctgtaggggatgctcagcgaggggctgcgagccctcaggacctctcctcctctctccctggaaaggagctggggaacccgtagtgcaatctgtggaccactcagttatggagagaggttgtgcccgaaggtggacactggggtatgtccctccaccacctcatcctccactgctatcctcagtacagctgcttctggtaagcgtgaggccatggacgccaccctcgatctgggctgacatggtccacttctcaaatttgagctccctgagtacatcatggagccatgctggttactcgctatgaggtagggcacaaacttctgatggaccctttgtcctggatggaggccgagacaccctgcacaatattcaccttttcccctcgctgaagtatcgtttctggctgctgctgctcttctccatggcatctagcgagcccatccccagtacttcttgagctgcaccctgtctgagaagaagtactcgccgctgggcctccgggtggtggccagcagggagcccatcatcactgtggaggctccaagggccagggccttgacacgtgccccacggtctggatgccacatcggctatgatggacacaccaaagtgctgagctacttggccaccttgtacacagcagtgccctggggctgaccgcaggccatcacttcctggtgatgcagatagagctgcagcccataactacatgcagtccatccacaccagtgtcaataggttcttagcctgggctgctgtcaccacattcctcccaatcacctggaggtggaggtattctgtttgatgtaatgcaccatggtgatttgatacaccgagttcccttgggaggagtcaagactatgacgttgatgcctacccaggtgagcaggtccaggcagtatttgtcatcctctgggtgcccacagctgccctgcacagcagctgcttgtgggaatccttggaggccagaattagtctcgattcttcttcaggttggtgtgggagacgatggccactagctcatggcgatcttgaccataggcagcttcccttgctaggctgaaggatctcatttgcctgtttcaatgtctgcctgctggagccaccatcagcttgatccttggcgtcatcacctcactgaggagggtgtgtggtccttctcagcaagaaagttgatgtctcgggaggagatgatgcccaccaacttgtccccatggtgcccatctcagtgatgaggatgcaagagaagccatgccggatcttggccccagcacatcacccacagtgtgtgaggggctcagcaccacggggtccgtgatgaagcccgttcaaacttcttgaccttatgcacctcgttggcctggaactctggggtgcagttgtgggaatgaaaccaatacctcccatcagagccatcgcgatggccatgtcggcctctgtctcatgtccataggggaagagatcagtggtgtcttcagcatgatcttccgggtcagggctgaattaggtctacctcatcagctatgaaatctatgaaccatgggagaatcaggaagttgttggggtgcggcagttggcgccgaggaagagctgctgcacggtgagccagtcctggggcacgagccggtgccgccactgatcagatggtccgccatgctgccgcaaggccccgcgaagcgaaaacacccgcgcggccgcctgccgctgctgccgctgctgctgacgctgtgggcctgggactgtaagcataatttttaatgcccatagtggtggttatttaaccacttagtgttgggtgcttggtcattttcatggaaacttttgctaatataaatgccactgataaacatctctgtgataaacctttatatttactgttattttctcagtatagattccttttagaaatggaattgacaaatcccttgaaagcctccaaactgtctcatttcaatcagttcttttaagagctgaataagagtattcttagctccacttaattggtcgagctgatatactagctttttcttgattttgtctgaagtaattaggttaagaaaagttagtttaacacatacatccctgaatagcagaactgaatccaccacagatgtacttcttactcgtctgaagtcaaatgtggatgtttgtatcagagggcggccctctgacaagtgacgattcaggggctcagctcctttcatcttttggtctgccaccttcaacatatggcttctaaggccactgacatcatctgtgttgagctgtgaaggagtggagcctgggaagttttttatggactaaatattcccaggaggaaaacggagtagatttatgatcacttatccagaacctgctacaagatttctccttatctcatacttgcagctgtcagcaaatcctgttggttttatctttgaaatatcccttgacttacccacttttctccttgcccatgcaccccccagtcctggctggcgccatcactcccctggatcactccaatgcttcctcattggtatctctcttccactttgcccccttgccacttgcttctccatattcgttaagaaatctttattaaaacaaacagttccacgacattccccaggtaaaaaccatgtatagcgtccattagaatttattaaaaaatccaaactatttaccttgatgaggtcctgtggatctagccttgtctattctccagtctcatccattaccacgttcccctaactcgttaaagctattccaaatggtttccattcaacttttcaaatttgccaagctctttcttaccctgtgcctctgcgtgtgccactccctttgcccagaactttcttgttgttcttcacttgacaggtatttctgtttttatttaaaattctttttatttaataacaatgagaacacatggacacagaaggggaacatcacactctggggactgttgtggggtggggggatgggggagggatagcttaggagatatagctaatgctagatgacgagttaatggatgcagcacaccagcatggcaatgtatacatatgtaactaacctgcacattgtgcacatgtaccctaaaacttaaagtatataataataaaattaaaaaaaaatttattttttttgtgggtacatagtaggtgtatatattatggggtacatgagatgttttaatacaggcatgcaatgtgaaataatcacatcatggaaatgaggtctccatccccttgagcatttatcctttgtgttacaaacgatccaattataattttttgttatttaaaaatgttcaattattgactatagtcaccctgttgtgctatttataaatggtaggtcttattcattcttcctattttttttttttttgtaatctgattatttctgttctttggatttcagcctaccttcatggtgtgaacgtacttggttataatgcattgcttttgttacatttttctatttgatctgctcatattttgtggggcacttttgcatgtatgttgcgaggaaggttggtctagagtttccttataatggcttcctctggttttggaatcaggtaatactatcctcataacatgaattgggaagtattgccttctgaacactagtttctgaataatttgtgtaggactcttttttttttttccttaaatgttttatagagtgcagcagagagacatctgggcctgaagtttactttgtgggagggttttaaactatgggttcaatttcttaattgatacagggttggtgaaggtttctatttctttttgaaaaagctttggtaatttgatctttccaggaatttgtccatttcatctaggttgtcaaatttataggcataagggtttttaatccttttaatatctgaaagtctgtagtaatgcaccagactttatttctgatagtccttttcttcttgatcagtctacctaggtttatcaattttgtttttttttttttttttaagagaatcagctttgggtttcattagttttctctgttatttcttaattagcttctcagccaaatgttttctcagaaaggatgtttcctgaccattctacctaaggtggcttcacctttccttgccttctcctctgattatttgttttctacctcaggtctatgtgtaattattttatggttatgtgctttttttgcttctatgttacttgcagatattgcagaatagtaataagtctcctaacatggtaatgtgcttggtgaatttccaagaacatatatggtggtttccaagtatctagcacagcagtatctatagtggttaagagactagggtctagagttggctcatctcagtttaaccccggctacatcgtacactaagtgtgtgaccctgaacacgtgtaaccgtgaaccaaattctgattccttctgagatgagggttgtgcaacatggcagctgtgatcaggaggctggggtttgagttctggctctgttacctgtcagctgtgtgattcttgaggcaattactttctgagacccaatgatatggtttggctgtgtccccactcaaatctcatcttgaattttactcccacaattcccacatgttgtgggagggacccagtgggaggtaactgaatcatggggtggatctttcttatgctgttctcacaatagtgaataaggtctcatgagatccaatggttcaaaaagaggaattctcctgcacaagctctctgtctttgcctgctgccatccatgtaagcttgacttgcaccttcttgctttccaccatgattgtgaggccttcccagccatgtggaatgtaagtccattaaacctctttttcttcccagtttcagttatgtctttatcagcagcataaaatggactaatacactcaattttctcttctttaaaatgatttgatgcaaggagtaccaatcttgggattattgggaggaactggatgagacatacatgagtaggatctagcccaggttggccttttgcatatgaggcattccctcaaactgtactttcccagaacttcagctctcccaccagagggtaagcatcactgtagcaggcactttgcacgttttgtgcacctctgtacctcactgccttgatcagtgtggtcagacaggcactgaaaaatgcctgtgaaatggattctctttttgttgcttatgaaatctgcaactgtgagttgagtgtcctgaagctcagcagggaacgatggcttcaacaatctggcccttgcttgtctcaggtgagctgctcctttccctttaggaatcttctaaactgctgggattcccagggggaggacgggacctttagggatcttgcaaccccagcagaatatcagttttcttcacagaagcgtgtctaacttccttcagccctggctgcaaattccagacatgaaactgtgctatttgctagcttggcctggcaggtatttattaaaggctgcaggactccatgatagagagtagcaacagagccagcaggatcctgtaagtatcctcatgcaactacctgcagtggatttaaagtcagctcagggcagtttcaacaccagattggaggaaagaggttgtgtgtacattgtcctctggggactgctgctgtttatgccttgggtttcctttgggggagacagatccaccctgctttcctcatccatcttcctacatggattatcttgttatctagtgctgaaatggcatggacacaggggctgggactagtgctgagatttccgcttagctcttccaaatacagaaagaacttccctgtgtatggttaggattgaagtcatgtgcttggttcaacattccttcaatcagcaggaaatccagtcatcatcctagccctcatttcattctttgtcttgcttcatgatgtcccttaggggtaaagatttctgaattcaagccagctgagctgggttcaaatctccacatgtccatttatgagatgaacatcatgtctttgtctgattcatttgtcttagtttcttcctctgaaaatggaggtaatggcaatgtctatctggcatgttctcgggaggctgaaataacacccaggcttgctgcttattgcacagcccacttccctgccttccttctctcccttcatgaatccctccatgtcctgctctacctgttgctttctgttcataagagtattttgaattcctgccttattctccttttttctctagaagtgaggagccaacttccccaaagtccgtggaatgccattttactttgttaggaaaaaaatcatttttcttatgtgcattctcatctatccattcaacagacgtcatcggagtgccttctggggtcaggccacttccaggtaccagggattcagagacaaactagtcacgctccctatcttaagggacttagaatcatccccagagaaggatgctgtgaacaacctcacgtgtgatggtgggccactttggttgtactagagtggtgggatttgggagttttttcttatttttatttattattgtaaatttttttaaattaaaacaattttaaatagagacagggtctcaatatattgccaggttggtctcgaattcctggtctcaagcagtcctccctctcagtctcccaaagtgcaggattacagatgtgagccactgtgccagaccactttttcttatgtgtaaattaaaaaaaatttgaacaggaatgaaagataaaaagaaaaaaaaaaacacttccccaaacaaaaaaaaaaactctttcacttataagaatggtcatcatcttggctatttcagatggggaagtacgatgcctcattttatccaagtttctcacagttctataagtcttttttcacacacagttcctacacaaaaggtggctttgcaaaaaacttcttttaacatagctggcaggctatactgtaatatatctatacacatgtatgcatgtatgtgcatatacatatacctttgcatatatatgttatgcatacattttattttgctttatttagaattattatttttggagatagagtcttgcttgtcaccgaggctggcgtgcagtggcacgatcttagctgtctgcaacccccacctccgggttcaagccattctcctgcctcagcctcccaagtagctgggattacgtgtgcgcaccccatgcccagctaatttttgtatttttagcagagatggggtttcaccgtgttggccaggtgatctcaaactcctaacctcaggagatctgcccacctcaactcagcctccttaagcgcggaattacaagcatgaaccaccatgcccagccttatttagaatttcatagggaattctttgttattaaaactaagggttataagggcttccaaatcgctgtcatatggctggtctcaatgcatttaaacaccccctcccccattgattttttttttttacatggttttcttatgtttaaaatttgtagtttctctattaaacattgggtcagctgattctactgcccaggagacccggcaacacctcaaaagtccacaactctcttggccagatgtgactgttctatttcccagccatttttctgtgtctgcagaaagacacagtgcaaactgttaaatttggaggtttttggcgcttcattaaagggcaaggattttcctctttgggggtgggcttcatgttttaatggtcgggtcagcattgctgggtgaggatccttaggctttttgtcaggggttcagggccttctggttccccaggcttctccaggcttctccggcttccatctctagagaagactcgggatgaacctgaattcttctagaccccagctaccagttcggctccagacccagagtggcactgctttatctcggcaaagaagactaaagacttttttgtgtaacgaattaaaagtttgcttcaggctcttttattttatgcctctgctgcactctcgtaacatttagcacctccccctgttgtcaatcatttatcatatcgtggagtttcaggtgtcttattttggttttcctgtcaatcttcccctacactctgcgctcacaagggacatggaaacctgtcctgtttctcctcataccctgcgtcgactgcggcccctgcacacagtggggtctacgatgttgatgggagccaagggattgtgtactgattttttaaggctggatatttatttttcggtatgctttgcactttttgcctaggaatcaggactcagtacagaaacttgtctctgtcatgtgcgcaccctggagaatccaacattggaaaaaataaaaatacacatagagaacaccattccttcccataaccacgtaaaatgtgctcgtgcaagctttccatatgcaagagtgcttttgatctaatcagatggaaagccgaagcagaggggaatgaatgtaacttacatactgattattaagtcattcattctagtagatttattggactcctatgatattccttcttcaaactggtcctcctccagggcatggcacaccatcctcccagatgcccaggctcaacttcttgctgccaccatttccctcacacccctaccctgtgactacaccttctacatagtgttcatatccatccacttttctcttttctctgtggccagaatcctctaatcttttaccttgaaaggttcaataacagatgaatgaacagatacagaatgaatacgtcgaatagtttcttcaaactggtttgtgttaagagaaatagcattatatttttatttagtcctagagaaaaaataacaaccctttgcctctgcctactctcgtttcacagtcccttcacaaatattgtatcttcggttatgctcatgtgtgagttctgtatttaagaaggacattgataaactgagcttgttaaaaggaacatgactaagggaggtacaggcgctggaagtggttcctgaataacatcaacaaaaggataaatgtttgcatttctgagagtgagagaaatgaggaagtgagaggggtgagtagattgctatacccaattatttgaagggcttcatcttgaacatagagcagatacattccatggtgctctagaatctaagggaagaagtgagcccatagagacaaaatctacctccaaaaagtatgtggaagagctatgagctggctattaagtctagagttctgtcactggaggtagtcagcagagtaaacatgtcaggggcagggttccggcatacatatggactctcttgttttgtagattttctgaggttattaggacttctgcgatattcttatctatagataggtattgcttcagctgcctaaacccatatctccctgtcccccaaaacactcaagagccatagccataaaacttcaagaagatgaaatattttggggttagtaatacccttgatggttagagttatatgtggctgagattcttcttgtatctattcggtctcatttaagatggctgaaatgattgatcactgcccttcagagactcatatatttttgctctgcaaaatgtctgcaaattgcatcccagcttgtgcaaggagagccactcccccaccccaagtgtgttgtttctttcagtgatggtgattcagaggctgtgatacatcggcttactgttttgggtttcagctttctcatgactagatgtatgtctttggacaagtttacatttcccatatttactttctttgtccttaaaaaaaaagttgctgttgctgctgatagtatctatcctcatagttgcgagtgggtctcctattagagaaaataaaaggaattgctatattagttctttccagctagtctttgagcttcttgatgtcaaggatcattcattcttttcgtcccatgcctaccataggggatggcacagagcagacaatagatgcttgttaaatgatgcagcaacgaggcatccactccatgtctgtgagtgggatacgtctctcagagcaagagtgccccaggcaagagtgatctagaacagtggaggaagggaggataaatgtagtctttgattttggaggacctaagtttgaatcctagctctacctcttgctagctctgtggtcttagacaagttactaacctctctgagcccatgttagtccattcttgtgttgctataaagaaacacccaaggcgcctggcatggtggtgcgtgcctgtaatcccagctacttgggaggctgaggcacaagaatgcttgaacctaggaggcgaaggttgcagtgagcagagatcacaacactgcactacagctgggcaatagagtgagactctgtcccccccaataaaaaagaaaagaaaaaaaagaaaaaagaagaaagaaatacccaacattaggtaatttgtaaagaagagaggtttaattggctcaggttctgcaggctatacaggaagcatggtgctggcttcagcttggcttctggtgaggcccaggaggcttccaatcatggtggaaggtgaaaggggggtagcatatcgcatggtgaaagcagagcaagagagaaaggggatcagtgccacactcttttaaacaaccaaatctcatgtgactaagagcgagagctcactcattaccagggttatggtgctaggctgttcatgagggattgcccccatgatctaatggcctcccgccaggccctacctccaacactggaggtgacattcaacatgagtttggagggaacaaacacccaaaccatatcagaacctctgtgtccttattaaatagttggtgaaaatagcaccaatgtctaggagttcgtgtgatgattagatgagctgttctgtaaaaaatacccctctcaatctacaaacatactcattgctccataaatactgctttactattatctctaggattaccaccatgttttcagcttttcctgtcacccttgcctaccaaaagtggctcgatgttctagaaattgagactaaactaaactttgaatagattttcccaacctgccaaaatatcccccaaattatagcaataaccattccctcctagagtggggctactctccagcggaagatctgaaggttgtgtgagggatgctttttctcttgtctccctctatttcttgtagcctgagatatatagcaatttccaaggcagggattggtaaagtagactgaagcccaggttttccttgctgggagattaggctcttgtcccaagtttataattggtatccaaataatggattgagaggtgttggccagaggggagaagaactggcaacatcaccacctaatgaccccagggattctggccaaaagcagagagcaatctttctcgaagccccaacatctctgttgctcagaaagcttcctggcagtttgagccaacttaatcagactgttctcttccaggcgctcggaggttttcatcctttgggacaagagatagctctgagttacttaacttaccggttcttgtatacgcttcatgttgtggcttttagtttctgttctctccaaggtgagccattggatcttccaggaaacagatgctgagatggagttaggggcacaagaagtttattgaggggcataagtacctgggaaaaaataaaatagggaaggcaggaagtagaattgtgcaaggagagcttcagaccaccatgcagaccagacagtctctgccaacctaacagaaagctttgggaagaggttgcccatgaaaggagccccatgttgggcagaagttgccaggccccatgtcccctcatgccctgtcactggctgaggactgctctggcagaatgtgacctcagctcaaaagggaagtgaatcctgagggctctgaagccagaggatgtcagtaacctgcacccccagtggtgaatgacacattcttttttgaaggcagatcggatccaagtgtctcctccatggaagtccacctggagaatcacaccttgaaaaacattggccagcacgtctgtgatggattaactccgtggttagggagcctggctgagtgccaccatctgggccattcaaatcagttttctccacaatatttacttacactttctgggcgctaatcatcctggtgggagaactgattgttataagtgaatccagcaggggggcactatgccttcaaataacataaagctgcacagatggagtgacagtgtggacagacaatcatttaaaaagatgtgaactgaaaagcatcttacaagagttcaaagatcatcactataacaacgactatcgtttattgaatcatcaggatgtgccaggtgtttctacatgccatctcatttcactgggaggtgagtgggcttattactcccagtttacaatgaggaaatggaggtgcagaaagaagtaacttgaccaacatcagtcgaaatacatctcccatttccatcaccagctctgtgatccaacactcaacatctcttgccaggactaccaaagtcttcgaattactctcctttgcacaagcatctttgcttcttgctcaaaatctatcctcctactgaagccagtgggatctttcaaaatgcaaacccgatcatgttgtttctctgctgaaacggtttcatggcttcccgttgctatggtgataggaataaaatttgtctctgtggcctccaagcacttcatggctgacctcggctacctctggagccccacctctcacctgctccttcaaaagtaatattggccttcttgcagttgccctcatgtccccccttcacctgtctgacagggccctttgcacctgctgttcattctgctgatacttcttgactagtaaattgttttcagtacttaaatagcactcgctacaatttgtgatgttgctttacttttgtgattattgactactcctgcctccctgagctccctcaatgaagctccgtaagaatggagaattatccatctcactgttatatccccagcactcggcacctcaggaacttcacggaatgagcagacgtttcgtactggtgtttggaataacaaacattctgacttcaataccatgttgaaaaagcagagtccttctatttgggagtgaaggagggtcctgaaggtatcttctaggaagtagcatttgaactagcctttgaagtgagttacctttattctgtttctgactccagtaaacaagccagcaatcaaacccttagagatggcaagactaccttaacagagcaggtgcagatctcttctgaccgtcctactctcagaggacagcagctccagatagtatcatccttgtgaaaaaccaccaactccacattttctttgagccaggggaacactagttagctgaggaagggggtgcaagggaggagacaggatggcattctctttccttctctcagttatttgcttctcccagtgctgaatcaggcactccagagacagggccctgaattctgagctctggtgatttgcatttaattactagaatgttttatttttctcttgtaaaattgtaatgctgcttgcagcattaaaaggagtttttctggaatgaaaacaccaagcttttgagtaagtatcttttatgctgaacatggggagtatccaaaatagggagttgattttcataatggttttgcagttactcataatgatgcccttgtaagcctttaaggtcaaggaaaaaaatcataggtcagatgcacaaggtatggggaatgtagaaatttctttgctgtgatctaaattcctctagatgagtggtttttttgagcatttttaaattatttttaacaactatttggagaacacaaactgaaataacccaaatcaatactattttatttatttatttttccttttctaaaatttccataggtttttttttggggggggagggggacagtaggtatttggttacatgagtagttcagtgatgatttctgagattttggtgacccatcacccgagcagtatacatttaatccaatttgtagtcttttattcctcaccacctttcccctgaatttccagcgtccattgtgtcattcttatgcctttgcattctcatagctagctctcacttacaagtgagaacatacaatgtttggttctccattcctgagttactttattagaataatagtcttcagttccattcaggttggtgcagatgccattaattcattccttttaaggctgagttttattccatcgtgtatatatacataccacaatttgtttagccactttcgattaatgggcatttgggctgattccatatttttgcatttgtgaattgtgctgctgtaacatgtgtgtgcaaatgtctttttggtataatgacttcttttcctctgggtagataccagtagtgggattgctgtgccaaatggtagttctccttttagttatttaagctatctccaactgttttccatagtggttgtactagtttacattcccaccagcagtgcagaagtgtttcttttcaccacatccatgccaatgtctatttttttaattttttgattatggccattcttgaggaataaagtggtattgcattgtggtttgatttgcatttccctgatcattactgatgtgagcatttgttcatatgtttgttggccatttgtacgtcttcttttgagaactatctgttatgcccttagcccacttttgtttgggcttgctaatttgtttgctaattgtttttttttctgctaatttgtttgagttccttgtagattctagatattagtcctttggatgtatggttggaagattttctcacactctgtgggttgtgtatttagtctgctgactgttcttttggctggcagaagctctttagtttaattaagtaccgcctatttgtctttgtttttgttgcatttgtttgggttcttggtcatgaaatctttgcctaatccaatgtctagaagggattttcccgtttaccttctagaatttttatggttttaggtcttagatttaagtccttgatccaccttgattgatttttgcttaaggtgagagatgaggatccactttagttctcctacatgttagatgagggtcttaagaaagaaagtgcaggagggtcggatgcagtttagggatctgcccacattatcagccatccctgtccccaccactgcccacctctggctcactaggatctaggatatgcaatagctgcagatttggttaggatccctttccagtccctgggtttcaggaaggcttaggaccaggaggaagagcaaaagtgttctctgccagcccctctaatgaaactgctgatccaactcactggagactccattcctttcctgttgcttcatagatgagatcatggtaggatgcatctccaagacaccaaaatgatatatgtagggtgaagatttcacagggaagaagcccgggcctcattctctgttttccaacttcaaacatctctacgattatttgtttagtgtgtgcttaaaccacttgcattttaatttaagcacatttatttttaaaaagcaacttggcatcacagcagaaatggaaaaccagtatcacttcccacaaatagaaagtaagttgcaaaaatatatacacgaagaccaaacagctcagagactgctgcctaaggctcagagcctgaggcctgatctgctgttaaaaagggagattagcgagtgttgtagggtgtttgggactttttccctgatgtttcagaagagttgaaacagacttgaaagggagcaacttttgcaccatgtgacttgatgtatttaattcagtctccttgtaccacctaaaaattatcacagctaacacccgtgctatagctcacacctgggaaagggatctggtctttttcagtaaattgttaattccacattggttctagtctcctgggcaggctcagagaatgtggcttgagagtgatggagaggacaggttagttcaaggagttagttgtggttgtagcaggtctatgtgtgggggactgaccagtaggggaatacaaggagaatggggtatgtggcacaggtaaggaggagggcagggaaatgagaccaccgcaagaaagaactgatagttagaacagtggagtaaaatccacactttcactgttgtgtcggactttgccccttggaagacatttgggaaaggtgatgtggggctggaagtctatgctgccggccaagagagtaaagtgtgtgtgtgtgtgtgtgtgtgtgtgtgtgtgtgtgtgtgttgtgtgttttaccacaatttaaaaaaaattgaaaaagaagaacactattagttacctgaaatcaatatagaccatggttctcacactttagtgaacatcagaaaccccgagatgcctgttaaagcacaggttgccggtacaccaccgaagtgtcagattcagtaggtctgggtgaggccaagaatctgcatttgttacaagtctccgggtggttaggtgctgctgctggttgggaatgctgtaaaccatttactttggtacccacaggtccagagaatgtcagaatgtcactatctctgagtcccgtaggggctgtcaacctaggaggcacattagaatcacccaaggagcctaaaaacaaacatagaaacaaaaacatggatgcctgggccctaaacccccagtgaatctgatttattagtctggggtggggcttgggctcatatgttttttaaactgtatatgcatttagtatattttctttttttaactttttatttcaggggtacatgtgcaggtttgttacacaggaaacttgtgtcatgagtagatatattttcaagcttacagaaaagttgaaagaatagtagaagaactcctatattctctttattcagattcaccagttgcttacattttgccctatttcttcacactttttttttgtaggaatatcactgaagtgatattgtgtccttcttggtgcatgtatcaagagatgatgtccgttggtcttgatattggtgatattaattttgactccgtggtaaggtagtatctgcagtctctactgtaaagttgctatttcctctttgtaattaacaagaacttgtagggagttctgatgctgggttctgatgcttcctgcttagaaacctgcactagaagacgggatacactttcaatgtagctcctatattattaggcagatacattgagactattaaatatcctattccttatcatgtttttactcaccagctttagcatccattgatgtttttaactccatcattccttctctttactagtgttctgctataaggaagaacatttatttttcttttatactttatattagcatgggctcaagattcttaattttacagtgggttataatcattactgtcgttatttatatttatgcttaaattgtctcagattttatcggtcagcacctaacctggctcttgtattcttttgacacattcttgtcttagtgagctcaggcttccatgaaaaatatcatagactgggtgtcttaaacaacaaaaatttatttttttcatggttctaaagctggaagtccaagatcagggagctggcgtggttgggtttgagtaagggctctcttactgtttgcagacagctgtcttctctctgtgtgctcatatggccttttctcagtgcatgctgtggagagagagagagagagaaatctctcttcttcctctacttacaagttcaccagtccttcaaactggggtcctactcttatgacctcatttaaccttagttacctcctaaaagcccttctccaaatatagtcaatggcaggttaaggcttcaatatatgaatttgtaggggacaaattccatccctagaagtcctcattttttttttttttttttttttttggtgcacattccctactttctggaacaataagatgctcttggttcattttatacttttcctgcttcaaccctgaatcagcaatcagtcatttctccaagggtctgggttcctcttttaaaaaatgctttctggccaggcacagtggctcatgcctataatcccagcactttgggaggttgaggcgggcagacactggaggtaaggagtttgagaccagcctggccaacgtggtgaaaccctgtctctactaaaatacaaaaatcagccaggcattgtggtgggtgcctgtactcccagctactcaggagctgaggcaggagaatcgcttgaacccaagaggtggaggttgcagtgagctgagattgtgcattgcaccccagcctgggcaataagagcgagattccatctcaaaaaaaaaaaactgtttcttggtgagaataatatgcagtcagaactgagaactagagttctaaaaaaatcccctctgtatacccacattctatagatgaagaagctgttattaagagatagggaatgaccagctaaagtcacacagcaggcgagtggcagaactgagcctgtaactctcacctttcctcagtcagcactttttaaaaattacagcctcctgagccctcaccattttgtttgcaagtgtcttgtgattcactccattacagatttaggacattataaccagggacccagtcattttccttatggtatctcctctgtacacgtggcttagtgctgagcagagagtaactgctccatgaaacctggggcctcagattatttttctgacagccaggttctgatgcttcctgtttagaaacctgagtaggaggacaggagacatgggtttcactgtagctcctatattcactcactgggtgatcatcagttctctttgggtttcattctcattgatacaaggagagaaaccacactacgtggctctctggtgatgtcttgggcagagtttcccagacaatctcttccctacggtcttagacccctgggcaaaagccaaaaccggcacactggcacgtctccctcacgtaattggccaaacaagtcacgtgatcaaactcaaagtcaagaggtgaggaactgtatcctggttcttaagtgcagggaccacagaatcacgtgacagtgacatgtttccagtaagagatgaagaattgggcagttgtgcaatcatgcaatctactgcaaaaggttttttgtttttttttttcactttgttcccgggtattccctaaaacacccagagactgtagctcttaaatataaggctgattaaagtgatcgatgccacctgactataatactgtcacttgagtgaaggtgccaatgctacgcagaaatgtaggagagatgctgtagattaactgtatgtttttagaagctatggaggcccagccctcctacaagtcagggctgaacctagtggtctagtaagatggggaggcctgatgagaacaggacacacacctgggatgtgcctatgatgattgagatcttctgacagaggctgctcctttggagctaggcaagataaaatgacacaatttcctttgggacctgcaggctgcaagagaatggtacctaccccatctgttattatgacatacggaccctgcctgcagtgctgagcaatgtgactctgagccccacttgctcttctttcttctgggtttcagaaaggttggccgggctggggctcatgcctgtaatcagagcactttgggaggctgaggcgggtggatcacttgagcaggagtttgaggccagcctggccaacatggcgaaaccccacctctactaaaaatacaaaagttagccaggcatggtggtgggtgcctgtaatcccagctacttgggaggctgaggcagagaattgcttgaacccaggaggcagaggctgcagtgagccaagattgtggcattgcacccagcctgttaaaaaaaaaaaaaaaagcaacttttcatgctgccttttaccttatctttatgtataccttgagatttaatgcctctgagtacatgagatggagggcttaagagaagggcttgagttaccgtttagtttgaatcccgtctctactagcttgctgtgtgatcttggacagtcacttaacccatctgtgctctagtttacttatttgttaaaagggataaaatagaactacctcatagagttgttatgagcattaaattagttaatatattttatatgtttgaaacaggcatgtcacatagtaaggagtctataagagttacttattataaaaggcaaaatcattgaagaaaaaaataatgcttaattttccttctattcttgagaagagagaaattcaaactcttaagacaccctgatctctttccactgcaccctcagacctctggaggcaaaggaggtgatgtgtcccctgtattccgactgctaacgtgggaagacctcacacaacattgcatgtctgctaaatgttaatttataattcagtgtagagactgattttccttggactgtaagaagactcctttctagaacagaaaagatgaaaagtatgtgcatgtaattatggtgtttatgccactctaaaaaattattcctaaatattgtttgggtagaattatttagagaatgaggctagaaccatccaatcccaaagactcctcatttgactaaactcttctattctttgttgaaaggactagctggaggtatatcaaggcatgcagatgactaaactattgtgtgggctgttagaggattattattttaatacctttattgatatataatttacttatcataaaatgcactcattgtaaaacataatccaatgatttttaaagtaaagttacagattttgcaaccatcaccccaaataattttagaacattttcaccagccctaaaaaaattatctcaggcctgtcaatcattgctccaaccccagccccaagcaagcactgatccactttctgtctctatagattttccttttctgaaatttaatgtaaatggaatcatacaatatatagtctcttgagtctggcttctttcactagcataatgtctttgaggttaattcatgttgtcacatgtatcagtgttttctacatttcatttccaaataacattccattatctggatatataacattttgtttattttttattttttgagatggggcctattccccaggctgtggctcactgcagcctctgcctccgaggctcaagaatcctcccacctcagcctcacgagtagctgggactacaggtatacactaccacacccactaattttgtgtgtttgtgtgtgtgtgtgtgtgtgtgtgtgtgtgtgtgtatacacacaatacatacgtatttggtagagatggggtttccatgttgcccaggttgatctcaaactccggctcaagtgatcacctacctcagcctccaaagttatagatgtgatccactgcgcccagcaacattttgtttatttaccagctcatgggtatttgggttatttctacttcttgtctgtagggataatactcctgtgaatatctatatgccagtctgtgtggatgtatatcttaattttcttgggttgatacctataagtggaattgctgggccatatagtaagtttacgttttaagttttaaaaaattgccaaactgttttcacaggtagttgcaccatatcacattgccatcagaatgtacaagggtttcagtttctgtgaatccttgccaacacttggtgttgtccatatttccattatagtcattctagtgtgtatatggaagtggaatctcattgtggttttaatgttctttccataatgactaatgatgtttaactccttttcatttcttattggccatgtgtatttatctttgatgaaataactattgagtatagagttttttagctcatcttatttttgagctgttgttttattattgagttgtaggagttctttatatatttttgatacagttctttatcattgtatgatttgcaaatgttttctcctagtctggcttgtctttttattcttaatggtgtcttggagtgcaaaagttttaaattttaatggagatgaatttgcctattttttcatttatgctagtaaaagaataatgaatggttttgtgtctaagagctttccgcttaacccaaggacagatggttttctctaatttttttttcaaggagccttatagttttagttgttatatttaggctaagatctattttgagttaatttttgtgtggtttggagataaggatttaagttcacttttcacatattgatatcaaattttcccagcatcatgtgttgaaaagactatctttttccttcaaattatcctgtcatgtttgtcaaaaatcaattgacagtgtcagagcttatttctaacgttcagttttgttccagtgatttgtctctttcccttaataccacactctcttgatttcgtagctttgtaatatgtttgaaatgagggtaatgtaagtccttcaccattgtttttctattcaaaattattttgcctgggtctattttttttttggctactggaaacccctccctcttggtctgacagggttggagatagatatggtaaaatagagtataggggacagagaccagtaactgtgtcttggtcaccgttgtgtctttagcacctcatataatgcctggtaggtcctaatactaaaaaagctgtaaaataaatggataaatgtatcttaagatttttttttatcacatgtatcatctatgtcttgggattagggaaaatttccatgtcaaactaaagagtaaaaattaccaaggttttgatatgctctgatatgatcactactacttgagcctccccctcatcggtttatttcccacccatcatagctcctggaggaggatggaattaatttcaaggggatttggaagtaattgtcttgttgttagttataaatttttgagagatgatggaaccttatcaagatgcttgctgttgaaatcttatagtttcccgtttagacctctgttattattatctgattattgattattattatcaagggttttatatgtctaacagtgttagatattgagaggaccttctacatgttgcctcttctgtctgaaacagagcccctcaaccctcccggaaagaagcacactaccccaaactctctcataattcttagacattctccagacctcaacctcatcattactcttagaaaaatcgttcctaaaccataacctgtatcaactgccctcctggaacccaccatagcttctcgttggtaacacttatggtggttacatatttaacattcattgttgtgcttatttataaagctttgaggtatagttgacatacaaaaaattgcacatatttactgtaaacgttcaatgaatctagacatatgcatacatctgtgataccatcaccaaaatcaaggagtactgatatatctttaacctccagggtatgtgattaatgtatatttctcctcggggatcatcggttcgtaggggcaggaactgtattagttttcactcaccgttttgtccctattgattactaagtagttgacaaagtacaactaacattttaccgagcacttactttgtgccaggcattattaaatgctatggatatattaatatacttaataactacagtggcctcttgggttgttcttttgtcatcccattttttagataaaaaaactgaggcatgaggagagacattatgtaacttctcaacgtcatacagacaatatgtaatggggcatagagaagggtgtcaataattatttgtaaacaaatgaatggatgaataagagaaagaaagggtgaatgaagctcttcccttgatctagttggaagcatgtcctctacaagagtgctgacttatcttttcttgcgagatggatggaatacaaggctatggggatgcccaggagactgttttggactccagtgctgctgactctgagagaggaaaaggtgggggttgggatagtctaggaaatgctggcttcgcacaacacagcgagtgggtgggagccaaaaatagccagtcctttgagtagaaactcctctagggaggaaaatttctttgaaattggacacacaaattagctaatgatatccagacactaaagaactgcagttccccagacagcccgcggccccaggatcagacgctgatcttgtggagcacagattaaagatgccgcaggtctggggtgggtatagattgttgtgtctgccatcctcactcacagcctgagcacagaggtgaggacgcagccaggggccagcactctccttccatgtgtgccaatcctgcctccctgtatgtcctgggctgtttgtccaggatggaaagtggcactgtggcattttacctgtttgtgctcagtgacagttgacatgacacagagtctatgttggcagtatttccggccgaagcttaggaaatcgactttaggatgaatttttcaatctgggagactctaacagggctctgagcctgggatgtgcaaactacctgcacttatcttcaaaattgtgtccaaatggcgtttctcaagggagagggtccaaaggtttcatgagtaaacaacaacaaaagctttcacaaggtatgggatgtctccaaaagggtgagaatccatgatgatgatactgataatagcataataaagtaacttttctgagtgcttagaatttgctaaggccaggcgtggtggctcacactgtaatcctagcactttgggaggccgaggtgggcagattgcttgagcccaggagttcggaccagcctgggcaacgtggtgaaaccctgtctcaaaaaaaaaaaaaaaaaaaaaattactgggcatggtggtgcatgcctatagtcccagctacttggaaagctgaggtgggaggatacttgagcccagatggaggctgcaatgagctgagatcatgctactgcactccagcctggtcgcagagtaagaccctgttccccaaccctgcccaaaaataaataaaaaagaaaatgccgatatgcattaagtctcttatatagatgatataatttaactgttgtatcagtcagtttagcaggttcatgctacagtaataagctactgagattttggagttgtttatgaaagttgattcttgttccagttatatgaggttagttgcagctctgcttcatgtcttagatgcaagagtagactgacggagggctcctttctaggtcattgctaatctcatggaagagggaaaagagaggatgtagatgaagagatggatcttaaagattctcctggaagtggcactgtcactcccattacattccgctggctcccagcccaacattggcgaggattccaattgtccagtagggagagtcctgtagagaggagggacagcagatatttgaacaataacataatctattacattcctataaaaaccaatgcggtagatatagtagtgattattatcattgtccctttcttacagagtggaaactgaggctcagagaggttaactttctccccagtgctgtgtatttattaagtggaggttcaagatttgcatggacttggtcagactctcgagcctacagctttagcc

SEQ ID NO: 5000 - DNA, 16917 bp, Homo sapiens
  misc_feature (1661)..(1922): n is a, c, g, or t
ttacaggcatgcaccacggcgcccagctaatttttgtatatatagtagagacagggtttaccatgttggccaggctgatctcaaactcctgacctcaggtgatccacccgcctcggcccccaaagtcctgggattacaggcgtgagccactgtgcctggcctatatttttttttaatattgcaaaacagacacaaaagctaattgaattacctgagatgactgcgcaagtcccaagacatctggagatttcctgacctttattctagtggttttatctgggggcagaactggacattctgaggtgttttcagaaaaccttgaatttgcatctctcagcatagttccctctcaaagtctttgtgaaggagcagagccactgaaattgcattgctgctgtgtcaaaaacagccacggaaaagagcaagaataatttcctaggaattgcatttcaacccggaaaagcttccagatcctcagtaacatatataaagagcagagtgcattgcatgatttccatctcaaacttctaatggtttttgtgcctattatctagaaagaaaaatatgttggtgaaggaagtctttgggtaggttgtgtctaggaattcacaagcctgaagcaaggcttttttttttttttctagcctccatccattcaccggttcattcacttttaaacaatcactaaaactattatacaatacttatccacaatctagttgctacttctggtagccagcaccctgcccccccaactccaaggctgggatggagaaatagtttaatgtcagttttttaaagtgacaggggtcatgctgttcatttttgagaaaatactgcagagtattaaagggaataattaataaaaattagcagttaactaatgggtagaacctcaggtgcacaacaatgctatgatcaaagaaaaacttttttcttcaaattaaataaaagtttcttgatagaaagtaaactcattttcaggcagtcagttgttaacagtctctgggcagttcccataggggcatgtcctgaggtttgcttaataaatacatttttattgcatgcaccatccattagtgctaacacagatgcttcttaaacacgcgtgtttacttcacagcacggaacatttggcttattatagctgcagccaaaaaaaaaaaaaaaaagcagcatctgatttccaaaaagggagtgacatttgatttggggcagctcttgtcatgcgccatctccacttagaaaatccaccctgtacagcccggcccgcgtcagggacccttgcaggcggcagcacggctgctgctgacgcgcgtttgatcttttctgggccaccgagggctcgccacaccccgctctggcgcgcacgttcctcgctcggcctcgcccagcaggagccagaccttttacttttttggttcaccacgcggtctctgctccagagagcgcgccggcggcggcgcactcgggcctcgcgcgcactcgcacattcttccccgggaacgcgggcggggggcgcgaggaggtggccggcccgggctgcggtccctctaattatagcccggcagctggcgcgctggcttggcctgggctcggggccaggactgggcggcggagcggaggggcggggcgcaccgggccgtttcccgttccgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgttccgccccgccccgccccgcccgcccggggtcgcgcggctccacgtgcgcagagccgggcgcgcggagactgcgctgcccagcccgggaaaagttctagaatagaggcgcggcgcaagtcagggggccgccttggaaccgcagcaagggctccttgtgggctccaggctgttggagagtgagggagcgtcctccccttccttcccgtggagtaaacagagcttggcagggctggaggctttcttccttttaaaaatgccattctgaacaacgatacaaagtgaaaaaataaattttttaaaaaagaaagggaaaactacaatttgaccattctgaccagcctccttgttccaactggcctcttgatttgtataagataatggggtccggcggcccccttgatgcatgaattgcacgctgggcataatgaactattgtgcgaaagcactttggacttcggactgtgttcctatgtcagaattttactgtggttgtaagataaactggaaggaaacaaactcgtggttaactcttgtcaatacgtgtcttgaccaagcaaagtgacatttcctacctgtggctttgactttaagctgcacaaaaggtaggactagcctctcagctgttcaaagcctagaatgagatgcctgcttagtaggtgttaaattaaacagcaacaacccatatggtgcttattaggagaatagtattccaaaacttctctaatgctgtgaccctcctgtgaaattctgatttcaattgtatatggggtacaataaatctttatttttatcaccagaaaagctaattgaactgctgtttgcaggcagaaataacaaaatggggtaatgggctcttagcctgggctaagactctcaacagcttttttctgttttgcagctcaccatacagtcggctcaggcagacggcccaagccaagcctgtgccaaagaaatgctgatttgtctgacccagacaatctctactcccacatgtcacttctctgcagaactcttactagtaggcaaatactttaaaaatcatacaataaaagaaggcaaaacctcagtaatttgaggttccttttaataaactctttccatgcattaaaataaattgaggccctgagctctggcgaaattgtttccgggtttttaattcccaccgcccccccaccccggaggcataaatagccacatagcaattcaaagtactctatttgaactagtataggaaagatgttttctatagatattgcaataaatttgcaatgacttaaatatttatctgctaaagttgctgagtgcctccacaacaaaccgaactcattttttgtgcacgatgggcatctgaatgctacctgatggtgatgatataaaatactaattgctaagtaaaagtggtaagtgatgtgatctacagattatgtaatgtagtcatttcccccaaaatgtaaactatatttagaaatattcaaatgtgacattattacccttacaggatgtcttatctcagcatcaagggcgtctgtagagctgctggaggaggctctttgattacgcaatctaacttctgacagcccattcaaaggatgagaaccggtgccttgaagcctcaatttaaactaggaatcctgtagtctagtctctagacttatctgacctaggcagaatcatctcctagaggcttttcatggctgattttgtgatgttttacttgcactgaagatttttattccatgttttgagttagtgttatacagtgccattctatatattttccaaataaattttgtcttacagaagaaactgtttataccattctaatagggttgtttaataaggaaatttactcagttgggttttggattaaaaataaaagaacagcttttaagatacaatgtctaaagattctcaataatgatctgtctatggtatagttactttttgtcctaaaataccttttcttgggttgtatggattgttttatgttgtgccaggcagatgtgcataattttctgattaaaccagtgcaaatacagacttcatattctataatcttttaaagagacaagttacacttcaatcaaacaatcagagagctgtttcaaatcaagcattttaagttaagttgtattgacatgggagggagcagatgacacacctaatgagttaaaacaatgttcactgttaaattaggtataattaatgtaataactaggggtagtgtgggtatccctgacaaattatggatttatctgagattaatggaggaatccacagataatccataaatctacccattttctatcttctaaccgctaacgagtaatttataaattgtctatttgtgtgctttttaagttacagtgaggggttcaacatattaaggaaaatgcaggctgtcaagagaaacagcaacaagggatctatagagttttaatctggaaagtcacacccgtaatttttatttgattgtagtaccattgctgtcagaggctaaccagtggcactgaaggagttaaaacagtccccacccccactcccgatttctagaacccacgataaattgggtaaatatgtattccattcattggtgcatctgaccttggtctgtacagaggaaaggcgtgtcttctcatactgttccctatgaacaaaaggcaagcaaatgaggtgactcaggacttctcatggcctacacacaactgaacatttttctgaatgattccacgatacacttaggaatcaggaagagaaacattttactcttcactaaccaaataaaaccatcataaatcatatgcaaaacaacttttgagtaaagagggacttaaaagtctaggaattaaaaaggatttccatagtttccttttaactctcccccaactcccctttggggaataaacaaaacatctgccacatcaagagtctggtttgttttcttaactgaaaacgaaatgcagtcattaagtatatctttgggaagaggttttgaaatgttgagaattacttctacaagctgcactatttcaatttcactaaaaataaaatttagcatttttgttacaaaaacatagttcatcctattcttttaacctagttattacatgaaaaattgtttatcatctgtaacttgctaagaataggtttcttgaaaaccttaaatggactaataatgaaaaactattaaaatatatatagtgagggcccctcctagttaccagaccaccctagtgtaaatatattcaagtacacattcactgtgctgtttaatttaaaacatatagtaactctatgtatatcctagcctccaactctttatagtttcacaacttcctttcatagagaagtctgccaagccattaatcaataaaaagagtaaagctgcaacatctaggaaatttcttattatatgagagtagccagtaaaatgtgtctcatgctttctaccttttatctctatttataaatttaagtttcaggatatcaataaagctcaacatggctttggcttttttcattcctaagctttccaaagtataaggcttttttttttttaaatcccttttgtctttagcgcatttcctatggcccaacgtagctgttttattccaaagttttcaaagagcagctccaggtcttgagagtctttccagtgtcgtcactatcttctcttccaatctaccattgcagaatggctggttctgctgctagttgaaaaataaacaaatgcttctagccgtactttgttcagctcttttatctgtgtcccctatccagttgccctttccgcatccctggcacttctattttataccatcagttgcctttttgttccatgtcttttatctccgaagttcaggcaaaccccaaccccaaacccacacatcctttagtcacattgccattagtattaaaacaatagccattctaagcttgctttagaaaattaaaaaaggcctcagaaaatgtcagtgctcccaattttatttttatttaatgctaaaagttaaagaaaaaaaggtactgtaatctgacaaatgacagaattcaggtgatatttccatagcgtgattttaaaatataatatgttgatatctgagattacactcacttcagttgacatgagtttcatcatatatagaaaagtatcaccttcaacttaaaaaaagtaaaggttaaaaggtggcacacttttaaaatacttgtggccaaggaaaggtatatagtaaaagttgtaaaccatgtgtatgttctcataactttaatgtgaggccacatgaaagacagtacatctgttaaattctataaattgttaaaagcaaaaagggaaagcttcaacaccccatcccctaatattttgagtattaaaagcacagctgaatattaggatttgaaatctgatactgcccatgtacagtaagtagctttgtgacatttttaccagctgtggagaatctctgcactgtcatcaggtacaacaaaagatcaaacccatgtccgatgttaactttttaacttaaaagaatgccagaaaacccagatcaacactttccagctagagccgtccacaaaggccacccaaaggccagtcagactcgtgcagatcttattttttaaagtagtaaccacaatacacagctctttaaagctgttcatattcttcccccattaaacacagtacagagaaaccacaggttgccctttccacagctggatagacttatccaaaacggcagatggttctgtattaatctttttggaaagcatgtctgtattaagattgcaaaacatacaatagctaccacaaattaggtcaaacgactgatcaagttgtaacatctgtgaggtcaaatcctataataaagtgcctagatacacatttatacaacagaccataagagctgaattctttcaaatgtctttatgggcatgtaaaattgactctgcatttctgcatgtgtgcattcacatagagagaccagtctgcactgagtcatatatactccaacttgaaaaagtaagtgtaacaatggttaatcatgcaagtctgtttgtaatataacaatgactggtaaaacatgaattctcgacagtagtaataggtgcactcattaaaaacactacggaaaaacactgtatttggtgcagatctgattttcaagtgttagtaacttgaccattaaaaaatagttttgaacaatttaaaaggaaagacaaacatataactaaaaaagaatccaaagttggtaaaaatctgtattttcaatgtaaatagaagctaggctgtgaaccatacacataaattgtagaccttgaagccataatcagcctaattataaggccaagttacaaacacctgaacgtaaggatttaaaatagtgttctgtcaatgttaaatcataacagcacaaaagaaaaaccagtatcactgtgagacaactattctaataattgatgatttattggttttaaaaaaatcattttactgatgcaaaatagtgacaaaagaaattagtttacaaaaagacttctaaaaatattttgagaggtggggcctgtctttatataaaacccttaatttctttaatttccactagtttatcatttttttccagaacagattattcacttggtatttcaaacacatgttaagaaggaaattacaggtttcctccaccccatttgggctgtcactgatatgcccaagggcagtcctggcagcaccacgcggctgttacgtcattgtaccatactgtattcagcactcactagaaacagggtataggtgatagtatcacagcaatagcactacaggtaaatgataaacaaaacaaaacagaaacaaaaccaatcccaaatctccaagttcacctggactgtaacttctcttgcaactctttcaaaataaaggacaaagcaacaacaaacagacctctagggtgtttaaaaagatgaagtggcgctgcagagctggctctgctcaaagatggcagtgccatcttgtacacaccaccatccattataaccgccttcatcactggaattgtatcttatgtaaccaactagcatgcagcattgtaatcttacaactgtcacgtggacagtgaacagcggtcaactttgtcttaaaaaaaaaaaaacaaaaaaccccaaagaccacacaatcctgaaaatttcccagcagcactctcagtcatcagtatctcaggactgaacttttgagcaaaatagagattcaaaatccactttcctactcctctgaggacaattttcagggtaaactggtggtatttcccagtggcatgcccacttgacaacatgcccgttcatcatttcctttccttctccaccacttggcctccggcctgagaaaggggccagcaataagaatgacagacagtaaggcaatcttacaatgtcagaaaatgtatttggctttttttttcttttaaaataagtgcatacaaatacagctagaagcatttctgatttgccaagtgctctaaaaagcagcgcaagtcacagcctacatagaacggtaactgtcaccaggataataaagcaaaagatatgctaataacgttaacaaaagaaaaaaatgtctttataagtacatacctttttcgtcaaaaaaaatatagaaacacaatgtattcaaaaaaaatcaaaattatacagccattttatgaagtctacatttcccttgtcttggatatatatatatatggagatatatatacattcaagcagttttaattaagggtaatcattgggtttttctgaaaccggaaaagtcacgatctctctcttttttcactttcacatctccagcaaggatggttgcaatttccccttgcataaggcccaggggacattggagcccacaagagggcatttttccccactgggacaatagactctccactagctccctgctgtttgatgctttgtctggagcaagggaagcagaacttgtggaagggacggacgggcactgcacaaaatgggtgtcctccagccgctcgtggcagagggtcagcacagcggggcactggttgccagagaggagtccgggaggctggcagggtgcactggtccagtcctcctgtgttgcctgctccctggccccccacctctctggggcccagccttcttggttcatagaggacggagagggcggactgttgctattcctcctggtagtggagtgaactggttggcatcttttgaggcatgactgccccctgcattgtctgctactaagatcagggcgccatgggggactggccattctgggccgcttcaggcggtgtggtccggttggaatgagggaggcagtgggtggtggcggagacacaaaagaggatgtaggagtcatggggatcttgagccctctgtggatgtggacagccacggctgggcctctccgttgatcttagggggcccgactcaccttctggttctggagagggcttccttttccttgctgttcttgcaactggaaacacaagaaataaaaggaaaaaggtaacataagtggcggtgcactgaaagagatcattctcttctaacccgaaacaaaagtcgttacagaattcctcctctctaaaagcacagacagaaaatctcatatacgagtttcaggtgcacatgcaacttaaaaccttcaggcgtacgggattctgggcagcagactgatttaaaatggagccactgaaaatgacacgcttgtaactgcctgttttacacatgcacaaaagtaccctcgtttgcactcaacatgtgactgctaatgtcccccaaaggttaaaaggtgactggtgccctcatgctcccatccaagaatgtgctgggaaaggaaaccccgtgtcagagcgtatcagcccagtctgactcatctctgttatgctgcttcagcacagaacacgttgccaccaagcactggttccgcctcaggcagatcaggaagtggggtgtttgtgtttctgggctggggtaaaatggtgaatccaaagaaccacccttcctctgctctccgtcccttttctcccctagaccccctcacttcacagccgcccctacctgctttagacccgttgccccgttggcctcgaaacccaacaacctgcctgcagtcagggccggctccttcttaaattgctctcgaagggccccgagtggccgtgctggtgcagcgccagcagcgtgtcgcgcacgtcttgggcctgttgacccagtcctgctctccagacccgcggctcttgcccgcaccttcgcgctcagctcggcggccccggccgcggtggacaggctgtcggccgggccccggtgcgcggcggcggcggttgtttctccttggctgccgcctcacgctgctcgtgctccacggcagcctgctcgacacggatgccggccgcttgtgggcgcccagatcggtgggctgcgcggagccaggctggcggccgcggttccggacaccgcggctaaggaggcggcagcgcggccgccgagccgagcgcggtgggcagcggcgtggccgagccgttcatgagcggcaccagggtgggcggaccgcgtggccgcgccgcgggttcgggctctggcgattcagctcgggcggctcctctagttggagaagccgttgggcaccaggatgccgttcacgggcggcggctgcggcgtcggcggtgggccaggctcgctgccgggcggctgctgccgaagtcagagccgaggcgcgggggccttcggccgcggccgccaacgggtagcgctccaaggcctgcggcgcgcgcggggccgcctcgggccgccgtggccaagctgctgctgctgctgcaaaaggatgtccttggcggagagcggggcggcttggcggcggccgaggccgcggcgccgggtggggagcgaccctccgggaagcaccgtgcgcccgcttgagctgccgcgccgtctcgatgacgaactcgacgcggtcggcgcctcgtagttgacgcagccgcggcagacgggttcggtgaagtcccagatcatggcccagggatgcggggcaggtcacacaggtagcacgactgccgccgggacgcgccgccaccgccacccgcggcatgtccgaggagcccgcgacgccgaggaggaggcggaggaggaggagggggcgcgccgccgccccccaccggcaccacgcgcgccctcctccccccccaaccccgcgtctccccaccagcggcggcggcggccgcaaaggcggcggcggcggcggcaaagcccgcgaaggccggcgcccgcgcagcgcccccggtgcacgaggggcggcgggcgcgaggtgaggggctgcgccgcggcagcagttccccccggccggcccgggcacgggcgggcggcgcggcgcggcgggcggcgggcgcggcggtgggggctcggccggagccgcggcgggcctccagaccggggcgagacgggccgcgcgggcgcgggggagcgcagcaggtcgcggcggcggccggcacggagtcggggcggggggcggggaggccgggggggcagggggcggggggcggccgccggggcaggtcagcccgagcggcggggcatgccgcgccggggtggcggcggccgggcggcgtggagctgggcgcggcgcgggccccgggtcgctccgccgctctctcacagctcctggcgtcgccgcctccagcgccagcgtcagcggccagcccgcctcagctccgccgccgccaccgtcgctgcgctgctgccgccgcgaccgctccacttctacagacttgattcttcgacagtctcgcacgcgcctgcgcgggccccctcccctcgtgcgcgtgcccgccctcccgcgcgcgcgctcccctccccccgcgcgccgaaggagcgctgccgggagagccggctacgcggcgcccgcccgccgcggggcagcgcagcagcgcagcgccggtgttcccttcggaacaccgcgcaaagtgatcagtgcttttcctccactttccctcacttcgcgccccacccggctgtcccgaccaccctcggatgttttcctctggtgtgcctctgggccaaatcgtgctaaaaatcattttttttctttatgcaaggacactttgtcacttggtttccgtcagtctcctgagaatggggaatttaggctagcgtggttcacagttctggttttttaggagttatacttgaaagctcaatgtcggaccatagcatgaaatccgtcactggtgctttgcatttgtcttggaaaggacatacgccccgctgtcccttttactaactagggagactgtgaatattcccaagcccagcaccacgtgcaccgccgccagctggctcgcgcgttttccacggagccctctggaggggagggagcgcggttggactagcctctcccgaacaccaagtgccgctcttagccccgtccagcccgccctgttctcgggggcctcgccgcgccagtcgccccggctgccttatgtaggtatgcgcggcgggcggtgacgtgggcgcggggccgtgggcggccgccgccgcgagtgcgcacgctccgcgcagagtgcctcggcgccgctggcactagggcctcgtggaacgaatgcacattccagggatccgggtctacggccagcgcggccgcgtcacagcgcaggctccacccccttcggcgagtctggcgtcgaggcgccgcccccgggcccgaacttggactcgaggtggcgggaggcgagggcgcagtggggggggggggggtcctgctcgcctccgcgaggttcccgagggccgtgggggcgacggctggctggctggcccgccgtcccgcagggcgggccgccgacggaggcggacttttgcctatatgccacccaggccgggatgagcccggcctgcaggtctgccaccgttggcagcccagactcagcccagactgaattgaatgtttgagtttcgcacttttatcgggaggaggagtagtgtgtgttatggtaaatcactttgggctggtcgttagtctccctaatacacgtaggttagtcgctcttcaattgggacttttacacttaagctctttaagggcggcctctggagcgcttttgttgggaacacaggcccacaactctcccttgagactggaatgagctggttaaggtgggaagaacagggtactaattatattatctttcctacaactggattggtaggtggaggaaaaaaaaaatcatgctgacgtttctctctagtcgttgctattgaaaataccaggttgttcaaaggattaaccacaaggaagaggaaaaacacccttagagaaacagtggagggagcgcttaaaacacatgaaaaaacctgttcgaaaatggcacagaaaacgtaatgtcagacctaatgtttttacaggctaaccttgaatgtcttttggggatttccatagaaggtgcgcctgtttaaaggtctctgcatctgttcctggatcttgccctgcaattgcaatcctgcctcacctctccaagctgggagaatggggcctgtccagatccttcccgggagtagctggtgccagcggtttggtcactcccaggccctgctgttgcacaccgctttcaagacctgtccctttggtaccctcctcagagaccctgtgacactcattccagtacatgccttcacccactgcgtcacgcccaaaggggatgaagtccagtccttgtgctgcagagaaatgaaccaactcatcgccccaagagacggccccactaagcattgactgaaacatactaaaagaaaacacaactcaccatagagttgtggcctaattatactcatttctctgcaagctggtactgtaatggcctcaagggagagcctgccactccatcctaaaatagaattagagatagaaattctgccacgatactagatctttgcaaaacggagcttttcttctccaaaggaagagcatttccttcttattttaactgccagtttcatgtcgaaactgagttgttgtaacttccctaatgaaatgcccgatggaaatggaagggctattttagttctgggctcgatccggaatcaagggggttaaggctggatcagggcagcaattccttatattgtatcagaagtctttcatgcagcctggcctttcatgagctctgaagcagctttatcgatgtatgctaagtaaacatagctttgtttttgtcttcccccaccgctccctcccggcacagactggagttggatcccatccaaagcggctgctgcagagttacagccgcctcctccacacacaggagcagggtttctagggtgaggcaatgcgtctcaattcgcagagacaaggcaggaattgtaattgtagttcatcatgtgatgacttatgaagaggaagttggtatgttttagtcacgtagactctgccctcttgcttgaggcaccaggtctctcaaaagagaattatgatcatctttgccacccagagtcaaggttaccgggttggctgagtgtgctcctgcacattcatatacggacaggcaggcagatgctgggccaagtgtcggcacgcagcgggatgaggctggcttttcaccagaacactaaaatgttgcaatttgtcttaagactaaaggaaatattctatggagaacactcctgctgagactagacaaaccaacagtccttccagctctaatttctgagagttgtttttttttttaaataaaaatcacagtgtaggagaaaaggaaagccattcagtatgacactatcagaaaagcaggaataaggaagtggcttggaggcaaacctaagagagcagttgtaagcgatagctcaatgggtagaactaatgtgacctccgacactgagattgaaacgggcttctactgcgtgaacgttaaacatctaaaatctgaactggtttccagagcttactccagtcaagcagctattaacacacggaagccctgaactgaagtctatagagcagtgtaaagaaacggttcctacaagagtaccttattggaactttgccccaggttatgcagctgcaagaggggtgcaaccccattcccccagcagcttgtgggtgcttccaggagatagatggtattcctaggaactgctgagttcgtggctttcaccctctatccgaggtggaatcacagccttcattctttagagtgcagtttccttaaatagcatgatgttgaaccatgctaaagcttcttaaactctgatcttggcgtatttgaagaagagaaaaaatgcgccacatttcatctggatttctgtggacatcattgcgggtttcttcagctttggcaaaatgtcgtaaggtttgaagagcacacgtgatattcagggcttttccaattttttaaataagtatatatatttgaacacatttgtttatatgaatatatctacacatactatggagcaccagacataaatgaaccttctgtaattgatatgagagtcttccttcttagtaacagcatttttgagacaatcttactgtttttcaaattgcaaatattcttttttagaaatactttccctcgtttgacctctctctatagcctacctcccctgtgcacagagcatacagatattaaagagcttttgcatgtggaggagataaactctctgtggagggtctaagaatcaagccagataaatcacaggagctcttaatcatccacatattgtacacagaagctgttagtcggcagcctattgtcaacgtatgtataggtccctatttagagcaaaatttgggatcttgatgaaggttaatactcactgtgtcagaatttaaagagctaagtgagaaacagacaaaatagacaaaggaggattgaggtcacacacttgctcagtctgcaaggaaatttgtagaactggaagggattcacagccatttgatgccagtaaacctcctattgactttttggaaaaagcaggatgaaatgccttttctggaatatctggatgtgggtttaacttagaatatttaaaacactcactgaagcctttgaaagatatcagtaggaagatgttgacaaaataatgaattaacttcacagataattttgaaaatataaaaatggtaaattttcccttcttagcttttctattaaaaaatgtacattcctacatacacattccatagcataagaactgaaaaagtcaaataatgtaataattctaaacgttaaagaacagtacgatggcatggtatttgctgtatctttcacatgaacattttaaaagatatttcaaggataaattctattctcttgtcatccttttcagaaactaaaaaccgacttacctaaagtaacatgaaaagtgagtgtcagaggccagacgcggtggctcacgccgtaatcccagcactttgggaggccacagtgggtggatcaggaggtcaggagttcgagacagcctggccagcatggtgaaaccccatctctactaaaaatacaaaaattagccggacgtgtggcatgtgtctgtaatcccagctacttaggaggctgaggcaggagaattgcttgaaccgggaggcggaggttgcagtgagccaagattgtgtcactgcactccagcctcggcgacaagcaagactccatctcaaaaaaaaaaaaaaaagtgtcagaactgatatctaggtgtgagcctgttgcctgaggatgtagtcgagaatattctatttgcattttgcattgttaaaaatctgtaagcacagcatagagcccagcaaaggagtgttaacatctgagtgttaacaggaaagtgttaagatttgctatctatacctatatttataggaaaaaggaaaattttaatatagttatagaacaatcaatccaaagagaagtaaacattcaccacagacaaaaggagctgacagagtagggcacagttgctataacaccatgtcgagtgtgggactct

SEQ ID NO: 5001 - DNA, 55999 bp, Homo sapiens
gatgggacaggaattttgacataatggaaagggcatgagactagaaacagatggaattcgctattttaggtatcaagtaactcacggacgtttcttaacttctccaggactcactatttctctttattaaaaggtgagttctggtttatatagtgcttacattggggacatgctttctggacagagcacgtgtggtccaggtgcagcgggtgggaagtgtcctacaaccactctggaccaccatgatctgtttccactggtggccatgctcagggggtttcatttggagaatgagtctgaggctttaccagtttttaaataactggtgcaaaaatgttttaagcaagcttctgttctgaaattctctatggaatataaatgttgagtgccttcagtaaaggatgattagctatcaaaagtttcttcacgtaaccattagcacattatatctccatgtggtgtttgctgataatgggtttactagcaataatctgcatcttgcatttgtatatatataagtttgagtaagtgtccaatcctagcatgttctatagattgagagtccctcacaatcatgataagcttagaaattacttccaaagtattttcaaaaggtaaacttacttggctgttgtattatatttattgatgtgtggcttacccactaaagtaagtgggagttattgtttagctttagatgtcacttggcatgggtgtgagtggctcctctgtggtccatagcggtacttgccctcaccgggaactttacctccagcctcgcatcttgcaaatctgggtgctacatgaaaacaggatcaggcaggaagtatggatgaatccccaatatccatgctatccaatgaaaagcagtcaaaaacttactctttttttttctttttggagacagggtttcactctgtcacccaggctggagtgcaatcgctaatcttggctcaccgcagcctcgacctcctaggctcaagcgatcttcccactctagtctcccagtagctggtgtatacggccatgccaggctaagttttgtattttgtatttttgtagaagggggtctaactatattgcccaggctggtctcaaactcctgggctcaagttatcctctgcttcggcttcccaaagtgctgagcttacaggcatgagccaccgtgcccggcccaaaaacatattcttaaagcacaatggatagcacaatttacctgtgccaaacacaaaccaaatgcaacaacaataacaataaaaactcatcacttcagtgacaaaaaatgagaagttcctttggctatttaatttccacaaagttaagtaccctcccccagcaaaaatgaaaaatcactgcaacagacaaactcccctgttcctgaatgacacttaaaccaagtaaaccaaagatagtttgggttaatgtatatattttacaaacattttcctatttttgaaacgagctttgtcaaacagtttcttcattttgacaattttaattaggagagaccaatcttatttttgtgataattcagtcctagattcattatttctggaggattctaatttattcagacaaatggaagagaaaagaagagtaaaatatacatatccattttattattaagattttaattgtctgacattttaacagcattttcttttccttcacattatggttccaatcctagcttctgcctgtaattttgactattaaaatactactccttggccgggcactgtggttcatgccggtaatcccagcactttggaggccaaggtgggtggattgctcgagcccaggagttccagatcagcttgggcaacaagtgaaatcctgtatctacaaaaaatacaaaaattagtccagtgtggtggtgtgcgcctatgtctcagctactggggaggctgaggcaggaggatgacttgagctcagaaggcagaggtttagtgagccaagatcatgccactgcactccaggctgggcgacaagtgtgagactctgtccaaacaaaacaaaacaaaacaaaaaccccagaactactcctctgttaggcagaacagttttttaactcatgggctataaatcttcttgtgatgaagaggtatcatttaccaacacaaaatatagagagttcccatgggattttgagcaagtaaatgattcttcttaatctcactgaatcaaagtgtcgttttcttttaaaaatctgctctgaatatgactgattcgtctttcctaatgcaaggtgatttctaaggtcagccagagagaaagttgcctgtcagtgatctgttttatagtacaaggggagctatctatgagtggcagggaaaaaatagctgaccttaggtcagccatgaagactctgccagactttggattctgattttttaaaccaagttgtaagaaaacaagcacttttaaacctctttgctgcgctttcaaaattctataaatataccttcattatagcatcttaatgttgtattgtaattatttgttttactactgcagactttgatatcctgcagaaaagagtcatgctttattcatcttcatgtgtctagcattgaatctgttgtgtaacatggtaatgttcaataactgctttctaaatgaatgcatcttaaatgtgtccaagagggaggtttatgatttacatgtgggataaagacaggaacattaacggttaaaatttcgcatccagcaaaaacttttggcttaacaggtggtaccttaagctttatatgtttcacagtgttcaagaatgtcacgtattttatctcatttgaccctcactgtggatttggaaggttggcagagcaagtgtatttccattatacacatgaagaaattgagctcttgcataagtaaattgtagcactaagttataactatgggcaagttatcctcgctcttcactgtgtgatgagccaacctggacaacgatgtgtgtgtgtgtgtatgtgcatgtgtgtgggtgtgtgttgaggtggggggtgttcctctgtcgggcatgtcaatctgtttattttatcctcttatctttctttatcacccttagaaaagataaatgaaagccactgtcttcctagagcaggcatgtttggtagctggaagccgtcgtgttcttggggatgcctggaaaagcccaggaagcagtaagatgggtgaggaagcaaccagccagaggtgtgattggtggcgtgggctcttcgcctcctcctctgttttgcctgcagttgaacagttttgtgagtctgggtggtgtttgggtctgtgtggagcctggttcctatgacgtaaggggacccttggctaacaagagcttttgttaccactgggggggtggttaatagaatgtgggttttttttaaaaggataattctaccgtgcaattgtgtagcctctttattacaattagggaagaataatccctgaattttttttttttttttttttttgagacagagtcttgtctgttacctgggctgcagtgcaatgacacgatctctgctcaatataatctccacctccggattcaagtgatactcgtgcctttgcctcccaaacagctaggattacaggcgcctgccccacacccagctaatttttgtatttttagtagagatggggtttcatcatgttggccaggtggtctcgaactcctgacctcaagtgatccacccgcctctgcctcccaaagtgctgggatacaggcatgagccaccgcacgggcccctgaatttcttaaatcaaagttttactataattatttaagggcagtgactggaccctatttatctttgtatgttgcagagtatttccatatctaggttataattatttgctgaacaaatgagatgcatagagggaaaacatcctaaatgaatgttgtacattatgcactgacattttccctccatgcatgtctttctctcctccaccaaggatattatgggctgtttgtgcagaggctgacttccagccattgattctgtttgagaaaaccaccgtcttgtctatagatcagtgtttgtacaggttgagcatccctaatctgaaaattgaaatccaaaatgctcccaaatccaaactttctgagcactgacatgatgaccacaagtgcgaattccacacctgacctcatgtgatgacttgcagtcaaagtgcagtcaaaactttgttcatgcacaaaattatctaaaatattgtataaaattaccttcaggccatgtgtataagcatatagaaaacataaataaatttcatgtttaggcttgagttccatccccaaagatctccgttacgtctatgcaactattgcaaaatccaagaaaatccagaatccaaaatatttctgtcccaagcattttggataaggggtactcaatctgtataatcatttaaacacttgaccacttggttttattaaagattcgaggaaattgagactacgatgcaaattattggttgtgctacagtgataaacttttatctcattatatgtgtttactccttgaatttaagacgttcagcttaaaaagaaaaagaacaagacattttgtcaaaaattatgcctaaagggtcaagttgtcagagaagtgctataatacgacaaattttagaaagtcccccccactccctttacaacataaaatgtagttttttatttttgttttcagttcataaacattttggaaacgcactgtatcagaggtaattagcggcattgtttggaaagatgaaaaatttattagaaaagatctttaaatgcttttactaaagcgtcatttaacaatttttcatattatagaaacagcttttcatggatgtgtgactgggtctgtatccaaacccggttcggttcctggagccaacggcgtagttaacatcagcctcttgcagttaacactcagcctcttaactgggagtggccctggagcaagtcgcggaatgttcaagctccgcgtcactcatcggtaccaagttgatgatctctgcctagggttttcgccaccctcaggctcaagtcccaggaggcctcctccgctgacttgggtgaacagcttgagttccggagagggttcggtctgcggagaagcgcgcgagagacaagcatcctcaaggtctggtacaaaatttggaaaatggacctggcgttgaaatctttactcctcgtttaaaaaaccatcgaaagggaaaaaataaaagaaattgcagtttatatttttgttatcccatgaaaattagctgcagtgttttcctcttcatgccaaagagattaatatttacggtgaagactttccaggaagtcgtggttttctgtaaaaaaaggttttacacatcagaaatcggacttctgggcaatttcctgaattcctggaataaaacaaaacaaaaaaaagcccccaaacaaaactcttcatctaaagcgttccctcctcactgtggtcctagtcaatgcgtggtaggtagcgtttcagtgatcaacaaaagtaaatatttgaccagtaagtctccaatcgagaggcccctccattcagctatttccgcccggggaccgaggaaatcctcaaaagccgggccacgcattcccagccgagaggccccagcgcagagcgcagcagcccccgcgagcgcaggtcctccccgcggtggttcgcccagggcgcttgggtctcggggaccccgcccccgccccgcccggtgttactcagcctcggtggcgcagggcggagtcgcgggcggcgggcgcaggtggggaggggcggccggacgcgtcggtgacacccgcgggggggcggggaaggcgcggcggccgcaccccaccctgggagaaaccggccaggtgtggcctaggcgcccagtgccagcggggaggagactcgctccgcgccgaccaacaccaacacccagctccgacgcagctcctctgcgcccttgccgccctccggccacagctttcctcccgctcctgcccccggcccgtcgccgtctccgcgctcgcagcggctcgggagggcccaggtagcgagcagcgacctcgcgagccttccgcactcccgcccggtccccggccgtccgcctatccttggccccctccgctttctccgcgccggcccgcctcgctatgcctcggcgctgagccgctctcccgattgcccgccgacatgagctgcaacggaggctccacccgcggatcaacactctgggccgcatgatccgcgccgagtctggcccggacctgcctacgaggtgaccagcggcggcgggggcaccagcaggatgtactattctcggcgcggcggatcaccgaccagaactcggacggctactggtgggtacctgcccggagagcgcgggctgggggctcgcgggacagggagggaccgtcctcctctggacgactgggagactcgggtcccaaggtggaaaggtttttttgccccaggtcccgaaagaacttcccggccgcgctgggagcggaccgggtgtcctgacgcgtgcggggacaggttggcccctgtcctgcgaacagggactggtcgtacctttctcccctcccgcgagcccgggcgggtggtcagagggggcgtcgggccgcgcggggctgtcccctgcctgctggacacggctgcagccgcctttgtcccagcccgcgatgggaggtcaggcgaggtggggctgcgaccacaaaacccaacctctccaaccgtaatcaagtaaaagaggaaaggagcggggccccggtcctgtctggtggccgagtggtgctcgggctccgcagtctctaccggctcacccccaatccccagtaaccccgagaccacgactgcaagactcctggactcctcggccacccaaggacgtttgtatcaaggctgcgcgtcccggcgggcggggtcctgtcccgaggaggcgcttcggcttcccctgtccgggaaacgaaacttcccgccggggcggctgccgggcccgggtctcgaagttcggccgggacgtgcctgttaccttcgtcgtccgcgccgcagcccccgcgggcgagcgcacctggggccctgcctctgagcctttgtttcctcctttttaaaaacaccggatgaaagaccccagtgtgccttggatcgcagagcccggccgcatgtctgctttgatccagaatgtgtgggcaggggagtgggggggtgggagagacgacgctgggggcccgccctggcctaggcgccccgggaagaccccccggtgagagggcagcttctccggatcccagcggaaacagaccgagggcgtcatttgggtgggtggggaaggatcctgtccctgctttgaccgggtctcgggagctggactctagatgcccacgtgagcctgcgcgttttgcagcccgccccacctccccgccccctgctagttgttcccacgtcgggctttgggaaagaggccctgagcgccgggacgttatttaccaggcgttgtggccctaggccgggaggagcaacctgaatgcgctccagggagttttgttttgcaagcagttttgaaggcaggactactcgagttgcaacctgttttctgcttagattcatttatttatttatggggcatctgaaaatctattttcgcttttttttttttttttttttttgagttagcaaagaattgtccaatcttggagttctttgtttcctgaacaaaatgtgtctggggatttccagggaaaatggccaagcaatagaaggaatgaaaacttgggttttcattacatttgttttaaaattttgcagccatttaaatctgaaatttaaattttctcccgcagtcctccaggatttgagatgcactcctttaaatgtgtgggttacacacagtttaaatccaagtcagaatagaatgcgaaggatctttagtagctctttttggcgttttcatgaaccaagtatttattttgattattatttaaactatgcttttgctagcttggatttcttatcttttaaatagacaataatcagtactataatcgaatatttcactcccttggcttcttataccttttgtaggggagtaaaactttaataattaagtggttaatgaactgcatcaaggtacatgttttattaggattccccattgaaaatttaattttgggcaggctccatgttttttccttgtgtagtatcatcccgtgctctgttttccaacttaaagcctacttacaaacttgtcaagtctcacatctctctgggaaggggaagagacccaagtgaaaaattacctgactttgaggaaggatgttttttcttctcattaatgtgctctgcccggcagcagggcgtcaagctcagggcttgagtcgggaggcggtcattcttccggggatcctggcaatggaggttcctctcgagcctgacccagcctgcagtggtgctacgactacaaaatagcccacaaatgctgacttctgcgttttcaaataatagcgaccgcctgaggcagggcatgtcgcagtttttctggtggcattctggttttgtgtggagggatatgttggctgtggcgtgcactttgtagaagcagggtgccctctgtgcccaagggagccactgcttctgctaagtgaatgatgattaagaatttcataagtatttttctgacccgaaggttttcaaataaaggtttttgtggttttcttttctttctttctttttttttttttagcatgaaaatagtataaaaactattggttgactttaaactcatttatttcaaaaactgctactttatgctgaattattaatagattggtgatttttgagatgagtgttttgtatctagcccttccctaataaagaaatttgaatgtgtggagggcccaactcttagttttcctttgaaaatgacttaaaacatctctctctctctctgtcctttccacgaacagcacttacccgtttttaggacatattagatctcattgtatcctaattccctctttttcccccgaccacctgcctgttcttttgtctttgttttagattgaatggaatctgcaactacttaattttgttaacatttggtaatgttacaaccttgataatgaaataatagacatgtacatgttttgaaatgtaaattttggttcttcttggataggacattatattaatactgttttcaattacagcagaattactctagcttattcctgtcattaaaacaaattataaatagtgaaatttgttaccaaagtaacaaagctcacagttagatctttctttcacccatcaaagggtgaatttgtgggaggattaaaagcgaaaatagtcattaagtttcagaaatatgtggttataatattaatgcttatttttcttcgatctcatgatttcaaaactgagatacgtgtgatcattatttcatatacattttaaagtagtcttaaattaggttttaagagaagcttatttcttactatgagacaaacaggtcaattgcctgaattttagagcggggggacccctaaggatcacttagcctaggcagaaaccccaccgcacacttcagagacaggaagctgaggacgtgccgaagatcctagaatccacttagggtgggttggcctgaggacccaaggatcctcaccttggttttccctgtgccttcacagcctacttttagaatggacaggcctgtaattacaccatgcaagtatctcaaattccattaattcttaattcagcaagtatttaccgagcattgactgcattctgtgttaagtgtcaggggagtcaaggtggaaatctatagccttgaaaggagtgtaggcccttccaaggaagataagtaccgaagactagcacgcaaaagcggaatgcacaggaggggtgtacgtgacttcagagacttacaaggaggtgagagaacatctgtcgtgggggcactgggaagactttataaaggaagtgtgtcgaactagactttggagtatttcagctgtgtcaggatgggtgggcagagagccttcagagggagagaagagcatgagaaaagtctgcgaagcctgtggagtgatctccttttagacattctctctgagcagggaggcagtaagatgaaaggaagaagcatccttttttgaccaagcattggagaccttgaatgccccggagagggatttggataggcagagggaagctggtgcggttttcactgaagccattgaaagtctcctccattggaggagcagggaagtgagacgatataactgagcttctggactgtttaggcgttggcttaaggaagccattgcaccagtgaagagggagggaatgaaagtctgaaccagggtgagggcagtggatggaaaagtaggtattgcaaggtggagtgacagcttcagctaagaattggatgcgagagacaagggagagtctgagaaacaggcccagagctcgagtgactcatagcgtagatagtctaaacacttttctgggaaatattgcaaagcaagatttagtttagcttaatatacggcaggtaacatttacatggttataaatttaacttgtatattttataaaaatatcaggtctgtggttaataatagttaccattcccagcaaatacctgtgatgtgccttgtataggatgtttgttatctcaagcctcataacaacttcccagtttacagatgggaagctgaggttaaaatatttaaatggcttgcctaaggcacacagctagttaagttgttaagctagatttgaatccagtataccacaatgacgcaaggaagattaaacctgcagtgtgagaattcaccttttctacttgtaaacccttttctatctagttattacttatttttaatctgttgaattcctcagtctgcgttcctgtgaaatatttctaatcattgtattctttcattaatactcttgtagagtttctatctgcttaggaaaaaagaactcaatttgattctgcattaagccaactaattgttagtcagatctatttaatgggacatacagctttcaacagtcatttttttctctaaatatgggcataatttcattgttcaggtatggaagtgtcttggaaagggaaaaactgctgatgcccctgatgcctcagtgctgacttttagggtggagcaaaggagggcttgggtgtgagacttggagagtgtgtcttgactctcactaaccagtctttccagaccaggaggttctagaaggagtggtttcagtctggaggccttttgctgcagctgggagcagtgcctcaccccttgattttctccatctccctcccgctgggtggtcccagtggccctgccgcttgaaaacgttcagatgtggttctgattttgaagtcacgccccacagatcctaagactcagacatgagctgctcatttgaggtgacatcttgtaaaaactagtgcagtccaataatttatggctcaccaccgacaccttgggctggaagggctcataatgtgaaatctacatttcatgaaaatgaagacagtttagtgagaagctgcagcaaacaatcaaaggttctgcttggaattacattttgtttgtttgtttgtttgttttgagatgggggttgctctgtggctcaggctggagtgcagtggcatgatcatagctcactgcagtcttgacactcaggcttaagtgactctcccacctcagcctctcgagtagcttgggaccacaggcggcgccaccatacacaactaattaaaattttttttttttttttgtagagacaaggtctcgtatcttgcccaggctggtcttgaactcctgggctcaagtgatcctcccaccttggccttcaaagtgctagaattacaggcaagagccagtgcacctggcctttgaattttcttaccctaataagtttctttcatgctgctaaagtgtatcactctctgtgaattgtctcagttattttgagtcttgtagggaacctgaggaactcctgaaatgcctcacacttaatacccaatccattcttccttttcctctttctcttttttttcttatcaccccgcctccattttgctgcaggcatccttaaagttatggactggggcaaagacaaaacacaaaaacgaaatttctgccggggcggtggctcacgcctgtaatccagcactttgggaggccgaggtgggcggatcacaaggcaggagttccagcccagcctagccaatatggtgaaaccccgtctctactaaaaatacaaaattagctgggcgtggtggcgggctcctgtagtcgcaactgctcaggaggctgaggcagagaatcgcttgaacccgggaggcagaggttgcagcgagctgagatcatgccactgcactcagcctgggcaacagagcgagactccgtgaaaaaaaaaaagaaagaaagaaatttcagaccataacaacagcagcagcctccgcaagtaagagctatcactaagtgaggtctccgccttgcagtgcccctctgagcctcacctcagccccaggaggggggtgttctacctgtcacagggcagaagctccaggcactgccagtggatgtcactttaagttgctcaaggtcacaggcttataactggaagtggctgagctgggcgtggactccaactgtgccctacttcaaagtcctctgaagttaatgatatgtgatcagttttccactatcccacaaacacaatctgccaaacaacagtgtgaaaatcgagaaaaccgcctggaaaagaagcagaacttttattagagtactgttctgtagctcctgggcgaagacaaaatgcaggatcaaaggaggctgtctttctaaaattatagagacaaaaaatccaccatgtttgctcactgctggagtgggaatggggaggggaggctgtgctctctggttgagcttttgaaatcagggtaatgagatgagccataataccctcgatgggtcttttgtttgcctttgtttttcttccactttactaagccaaacaaacatgcataagtaccttctgtgtgccgaaccttatttatgttgttaggttaagtgtttgtaggagtcaagatgactaagacatgggactttgctctccaggagcaggtagccaggtgtgtttaaataatgcaagagaggagaggatgcagaggtgtgatatggaaaactccttgcagaaggctgaacttttgaagttctgaacttttgaaggatggctaacacagcatttcagctgatgtataagagagtgtttaatgaatttttttttttttgagacggagttttgctcttgttgcccaggtggagggcaatggcgcgatctcggctcactgcaacctccacctcccaggttcaagcgatctcctgcttcagcctcctgagtagctgggattacaggcatgcgccaccacgccaggctattttgtatttttagtagagacggggtttctccatgttggtcaggctggtctggaactccgacctcaggtgatcctcccgcctcagcctcctgaagtgttgggattacaggcgtgagccccgtacccggctagtgaatcttagaggtaaagtatcatccttaaatgaagtattaaaaaatatttttctttttatgaaagatcctttcaagaaactcaaacaaaatagtatatgtgaaaatgctttgaaaattataaagagctaagcaaataggcctcacggtcaatattaaagcatatataactatcataattcctaacacacatttcctgagtttttcctaggtaattattctggaacctgaaaacagagagacatatgagtctttctggcatatgtacaagagcctgtgttgctgaatgaacaaaagaagaggagagagaggaagggagagatggaaagaggaaggaaggaaggagtccagttagagagaaaatatataaacaaaaagaaaggcaaagttagggggcatgtccaagtgtctaatgagcaacatagttattataaaagtatttttataaaacaaagagagaactcttcatttaaaaactttgtttttgcctataatgtccctctttgaaatatttgtctgtttttttgtgttttttctttatctttttgaaagtatgaactttttttcctttatcttttgaatatttttatttttttaagacaaggtcttgttctttcgcccaggttggagtgcagtgtgcaatctcggctcactgcagcctctgcctcccaggttcaaccatctcatctcagcctccatctcagcctcccgagtagctgggacttacaggcgtgtgccttcatgcccagctgtttgtttttgtttttttttctgtagagatggggtttcgccatgttgcccaggctgatcttaactcctgggttcaagcaatccggcggcctctgcctcccaaagtgctgggattacaggcagagccacggcacccaaccttgtcttgtatttttaaaaataatatttttggcaacacatgaaagctaatgccttaggacagctagttttggagtcctatttttaaagaaaaatgttttttaaaggtagtaaaataaaaccttgaaatcttggtaatattgttcacatattcatgtggtcgtctttggattagaatccagaacttgttttctttttaaccaccgatgaagggctctcttgcaaatatttggaatccttacttgtttaaacaagttttaggatgaacttaaaaaaaaatatgtgcaggtaggttctttgtaatatgactcatttatctctcagaagagttaaaaactttaaggatgagttatttttttcaagggcacctattaattttggtttggaagtcaatattttttgataaatttgacccaaatgagttgttttctttttctttttttttttttaaaaaagacatgacatctgccatcttctgtgccactgaaatgggatttaaaaatcgaacttcatggttgttaatttaattcctaacatgatttgaaaatctttcaacccctaacacccatatgtacagtattaaaaatttctttgagggtagggatttaaaaaaatgtgtatacgcttgtaagtcatcattttaaaattatttctttatccattatagaattttgcattttcccaaactgcacatatgaattaaatttaattcaattagcatgaataaatttatttaccatgaacttaacatgacatttgtattattttcagtaaggaagaatgagtttggtcatttcctaaaattgagttcagaatgaatgaggtgaagaaatcttacataccatttagcccaacagatggagatagaatttctgagattaaaaaaaaatctaaaattgtgtagtcaataacatatatatatataatcgacttagaaaggtttgaattacagcttttaaaaaaatgcatgtttcctggctgggagtgtgcctcccatctgtaatcccagcactttgggaggccaaggcgggtggatcccttgaggtaggagtttgagaccaggctggccaaaatttggtgaaaccctgtctctactaaaaatacaaaattagctttgcgtggtggcagtgtgcctgtaatcccagctacttgggaggctgaggcgaagaatcacttgaacccaggatgtggaggttgcaatgagctgagattgtgccactgcatccagcctgggcgacagagtgagactccttctcaaaaaaaaaaaacaggcatgtttcctaagcaagctctcctggctctcgtgctgaagaatccagtgctacacatacagctggtgtagtctgacatcagactgacccgatgggtcgaaatcatttccgctgaacttcctccctgataagtacagcgagttctgtgtggattcttcattgggctaagacaagcaaactgacctggcaggtggattccctataccttagttggcctgagtctccctctatcttgttttgatggaccagccattcacaaggtatatacctagttccttttctcgcctcggtctgtttccaaagggattcttggccacacctaagactgaagttggattcttacagatgaaagatagaagtagacctgttttaaggatcagacgcggtcttgaaaagttgtgtatatgatgaaatttcgttaatcgatcacacttcccaatagacaaataatgatatcaaagattctttatttcattgttccaaacttaagctttttattttttcaacccttcaaaggattagatttctgtgcattccccattctatacagttgttaatttatttactaagatgctgtgcaaaacatgtaagttttttagtgatatcaggaacatatgagacagggcgcggtggctcacgcctgtaatcctaacactttggaggccgaggtgggcagatcatttgaggtcaggagtttgagaccagcctgaccaacatgggaaaccccatctctattaaaaatacaaaaaaaaaaaaatagctgggcgtggtggtgcatcctgtagtcccagctactccagaggctgaggcaggagaatcacttgaacccaggaagtgaggttgcagtgagccgagatcatgccactgcactccagcctgggtgacagagcaagactcatctcggaaaaaaaaaaaaaaaaagaacatatggaaatggaaatcctttagaaaagcagaagaatttatttggtattattagcagcatataaagttacctgttgtttttttttttttttaagttcaaatatgggtaggcaagggaaggcaggcaaggtgtcttctctttataggattcaactgatctctagagaaataggaatgtcttctaaaactagggggagggaattaaaaacagagcaaacccaccaatgttttaagccaatgtttggttgccttacctcctttatcctgatgtaattcgtttctaactgtggtataactaaccagtctagttcttgggtaaaaagaagtggcaagttttatattttgtggtcaaatgaatttgatctcataaattcacttttaaaaagtgtatgtacacttcggtgcgttcattcacaattgtgtttgtcctccctgtctctgtttttaatacattttaattctagaatagttttagatttgcagaaaagttacaaaatagtacaagtttgtgtataccctcacccagtttcccatgcctccatcattttatttttttttaacacggggttttatgctgtgttgcccaggctagtcttgaactcctgagctcaagcaatcctttgccttggcctcccaaagtgcggggattacaggcgtgccccaccctcatcttatagctcgtttgtgattgtttttacagtggcacacattattaaatcatttaggaaactctgactttcattgtgctaagagacaactctttcatttatctgcttgggactggcattctttgtgggatcaccttcggagccaaattgctgaacagaatttcttaatgtttcagaataaaggtattctatgccccttcaatgaagaaaataaagataattacacaggaccttcctaattttttaatcatcctagggttctaagtgaggttgctgggcttcttaatgttttcctttgtctcttgaattctttcctctgtttgataacaggtacgttttggaaggtgttctaagtcagttggaatttgcacaagttaggacaacaaatgtgatcttgcttgtatctcagcagtatgagaaacggactcatttcctgtataattcggagtggaagacagagactggttgcattggtggtgggtggggcagtcttggtttcgagagctggatggctctggcaccacctcccctgggcctgcctggggagcctgtgtcttcttctgggagtagttcccagggaggtctgggctcctcacccacatcatctagtcctggcttgttggggagccttgcctgcagggaggaaccccaaatgggtggcaaaaaagaaatgctttcccatggtgagacagtgcagccaggtgcttcgggagaattccccattactgtgatcttatcccatctatgcataatgcaaccattgtttgtcaaacattttttttaaacagtgaaattctttctttaaaacacacacacacacacacacacacacacacaccacacacacacacacacacacacacacccagttggttagacaggcatcagataaaagcagctcaggctggccctggctgaaggtaggaagagccaacttcttgtagcacatccgtgagacttttcacagacattaaataatcacttggtctgctttaaatctctctgaaaccaaactcagtaggctgtgctgtggcataatatatcttggtaaatttaaaagccagactttggttaaccttgcttgaagagcaaatgaaactctgtcatctcgttctttaagatacagaccatctcaacattttccgccaacaccaccgttgttttaaggtttctgctaggtgtcttccagaaagtgcctcatttgaaatgtacattgaatgagcttcattgtagagaaaaataggtattctagaacatcttgaaaggagaatgggtttgttttgcgataaagacaatgtatttaaattttcatcactttcttcacaccatgatttttaaaaaaaacattattgtcttttacaggaattacgaaaatatatatatatatttttacagacagggtctcactctgtcaccgaggcaagagtgagtgctgtgatcatagctcactgtagcctccaactcgtgggctcaagtgatcctcccactcagctgcctgagtagctagagctacaggcatgcatcaccatgtttggctaatttaaaacaatcttttttttttttgtaagacagggtcttgctatgttgctcaggctggtctccaaccctagacttaatcagtctgcctgccttggcttcccaaagcactgggattacaggtgtgaccactgtgtccggccaatatttttgtagagtaagcttttttctcctctcctacctttcctcagcccgacttgccagtgaaatcttcatgctctgtgtctgacaccatgaggtcttcctcagagggacttgtggtgttggggactgtcattagggaccgctgtgggatgaagcaggaggaagctgaaatagctgtgtgtcattgtcattgccagaagtgtgtttttataactcagaggatatatttctggattggatcctggacctgggaggggaaaacttgctgtgaatgacattttgggctaattggtgaaatctgaacaagttctataaattagaaaatcatttgtgtcaatgtaaattttctgcttctcatcattgtattgtggttatatataagtgaatgtttttattctaggaatgatatgctaagatatttgggggttaaaaagccatgttctcaaatgattcagaaaaaataatatgtatacatagataaatatatgctgaaatatttgggggtagaagggcatgttattctcaagtggttcagaaaaaataatatatacacacagataaatacacacacatcatggagaggggagaagggggataaaagaaacacaacaaaatgttaacaattgggattccggtaaagggtctcacaggagtggttttgtcccgtttttgcaacttttgcaagtttgaaatatttcagaattgaaataggttatttgatgtctggtttctctgtgtttgcctccttagtaaaccggcacgatgtccaggcaccagaaccagaacaccatccaggagctgctgcagaacgctccgactgcttgatgcgagcagagctcatcgtgcagcctgtaagctttccctgttccatcgcttctcccaaagccttggccacacccgactgtcctctggttagcttctgctggccgggcctattcactgacctctttcacgtagtgtttagagacacgctttttcagaacagacacagagagatgtgtgtcttcttaacctatttgtaatgttggtttaacaatgagaaccagtttcagacagttccccgtccccctcccaacaaatgtttacactacagattgccaccttttggaaataaagcaatttatgatttacgtgactttttgatactttcccttctgagaaatgaacctggcatgtttctgttcctgggttgggatggatcttcatgtgcaccatcaatttagatgattttttttttcagagaaaatgactatattgagataacaattctatctgagaaacaaaaaatggggaaaaataggcaatggaaaattgaggagaaatggtaacatttctgagaacttgcgatgtttcttaagataactgagacatcctaggatctcatcgaatccagattagaatcatggagttcgtggtatttgctgtgtgaagtcttcattttaaaacactagcattcaccttgctccgagtttgctaaaaacagaatagagaatggtggggccgtagccatcttttctaccctttcctgagtcactgaatcttttcagcgaagtctccctaatgccgacactggtatcaggttacatctggcatctgcctcttcacaaagtaccccttctaaatagcctacatttgaacagattttaaccagatgaatttacgggctctgtttagataacattttaatattctaattcttaatttagatattgtgtgggttctagttctgaatttcttcatccagttaaaaaaagatgtcacgttagtccatgttcagagatatttggggctcagcaaactagcttggctccagtctagttgtttcgagtgtctgatttgaaacatactccttgaaatgttcctcgcagtggccgattcctttacacaaaacaaaatagcagacaccagtgacttaatagtgaacatacacaacacacgtcatttgtagtgactatggatacgttttacatgtagctctgaaaattttgcaggcctcatgttctcagtttatttttgcttatatgcatcaacgtgcaataaataaaaacagttagggaaatagtgtcatatttgctaacatttctgtttagagaaaagaggttcatttgctaaagccaagtaaaagcagcaaatataaaattccagagaaagatcagtaggtgttactaagcagaggaggaagctttctgtttttgtttttctgaatacaaaagcctttttaaatttgaagtagttatagactcataagaagttgcaaaaatagtacaaaggggtctctacccagccccagcttcgcccagtagtgacatcttatatgattatagcgcatcatcaaaaccaggacttgattggcccaatacagttaaccaggcagaagccttctttttaagaactaaaacgttgccaggcgtggtggctcacgcttgtaatcccagcactttgggaggccgaggcgggtgtatacttgaggtcaggagttcaagaccagcctggccaatgtggtgaaaccctgtctctattaaaatacaaaaattagcctggcgtggtggcacatgcctgtagtctcagctactcaggagctgaggcaggagaatcacttgaatccaggaggcagaggttgcagtgagctgagatcgtgcactgcactctagcctgggcaacagagcaaggctctgtctcaaaaaaataaaaataaaaaaaaaaaagaactaaaacattatgttctcataaggtataggaaaaactctgtgcataagagccccatctgtaccactgtaccataatggtacagtgtccttgtcacaatgagattcccatatatgagacttgtgtgtaaatatgaaagatcagcatttaacatactgaagcaaggggaggttagcattcagcaaatgtgactttaaaagccaagtgcaaatttaaaagacagtccacaactttggttcatgaatctccgtctgtttaccttcttatctcaataagatcattttcacggcgaaacttacagtttttgtcatgtttacagtggaagctcttgcttccattaatgccctgaaggttttcttcctggtagtatgtgttttccttcatgtgagtgttttctttcaggaatgaagtatggagatggaatacaactgactcggagtcgagaattggatgagtgttttgccaggccaatgaccaaatggaaatcctcgacagcttgatcagagagatgcggcagatgggcagccctgtgatgcttaccagaaaaggtattgtccacagagcatggatcgggcagtcccctgaaaaagaacaccacataaccagttacactcaattccatgacccagggcttcctttgaggcagcacaaatgttcccaaggaaaggtttgcttacttggtattttgcaactttattattatctctaatacaaagtgaccatttcattataggtgttaactgtacctccctttagaggcagaaagccctttggcatggcatttgactttttttttttttttttttttttttgagacaggtctcgctctgtcacccaggctggagtgcagtggcacaaatgtggctcgccgcagcctaacctcctgggctcaagcaatcctcccacttcagcctatcaagtagttgggctatcggctgtgccatacctagcaaattaaaaaaaaattttttgtggagacagggttttgccatgttcttaggctgatctcgaagtcctaggctcaagcaatcctccgtcttgtgcttcccaaagtctgggattacaggtgtgaatcacttaagggtctaatatcaagtcaagcttagtttaataatataaaaatgagacccttagagttggaaacaaagactataaggcagaaaaatgtagtcgaatttgttctactactacctggggcccagggtactaggaaaactcccaggacaaaacgaagagaaaatgaaagttgctcccaggttaggcaaaggcagtgacgctttctatgctgttcgcactttgaacctcttcctaagatttaattttttgtatgtgattaagacttaagtcctgggtaaagaaaaaaaaatcttcaaataccataaaacatttgtagcttctctattgacacaaagactcagaaaaggggaaatttgcccagaacgggttttcataggctgttttcctgcatggtttaaaggtttttttctttgcaggcttcttcagctccaagagcaaatgcgagcccttataaagccatcagtgtccctcgagtccgcagggccagctccaagggtggtggaggctaacttgtcagagtggctctggctgggatgagttcaccaaacatgtcaccagtgaatgtttgggtggatgaggcagcaaagggtaagcagcttcttgaacagcccaaacctgtgcaggccgacgttccagcacgatggggtcagcccatgtgtttgtgtgacaaagagtcttctagacccaggtggcggcagcagcttgctgtttgcaggattttcctcctatacaatttgaaaagtgtcttctattttggaatgaatgagatttcagtgtggcttggggaatcagcctcattgcttatagtcatcctttatcacacaggtcatatttaacatgtgtaatttagttagtagactttaatatccagttcttatattgaccaccggaaagatctgttgtgggagtttatgtgctaaaaacttcattgttctatgtgagtggcaactgacctcatctgttttactcataggtacttgaaaaaagcccattgtggcagttcatttaaaatggtcatagattggaggagctggaaacatgaaactagccattctggtttaggctcattggttgcttaccttagacttttgaagtctcgttgtctcattgtgcaaccatcacgtcaccagtgtgggagtgaagcaaaataatgttggaggatatgctgatcctttccctagaactggagtttctgcaaagtatttttcaagactaagattgttgtgttgtttcatgtagtcattatgtcctataatgaacaggtggtggtagaaaatgccacaatcatgtagatgggaattttataatgaaaacctactcctaacccttcccttagaatgtggatgtgttagagtgataagttgtggagagattgttatgcaatttagatgtgttgtaagaaagcttggtttgattagttgttagactaattcagcagtggttctaaaattttcaactcctttaaaatttttgtgtattctttcctaagtagtgaggacttcagtgactaacatttattcattcattcagttacctttttctcccatttattataaagaatataagctatacagaaggtaaggcttagaaagaacaaaagtcagttaaaatatcagaaacctaaatacaatctatttgtatgtttttcaaatttccttctaatcttcgagcacatttcttgaggatttatatgtagtgccacccaagggtacaaagattatggtccctagtcctgaaaatgaatgtttcgaagaaaacaagatgcatacgctcaaatgccaaatttctgtctagatcagctataatcattcttgcttagttagaggggagggtggccagctcctgtggagtggaacagtcacaggagacatagcggagctgatggggcttaactacatcttaaggatccacaatgatgggcaaacagccttccaatcaaattagtttgaaatgtcatatctcctaaagttttcttagtatgacgttataaaaaaagacagcctgtaatttgtcatttttttgtatttatgttgggtgtagctaagaatgtagtaaatgctcaatgtctttaaattttggaaaagtattaccacatgaattcgttttatgtcattttcttttttttttttttgagagggagtctcactctgttgcccaggcggagtgcagtggcatgatctcgtctcactgcaacctctatctcccgggttcaagcaatttcctgcttcagcctgccgagtatctgggactacaggcgtgtgccaccatggcaagctgatttttgcatttttagtagagacgggggttttgccatattggtcaggctgatctcgaactctgaccttgtgatccgcccgccttggcctcccaaagtattgggtttacaggtgtgagccccacgcccagccagttttatgtcgttttctaacagaagcaattgataagcgatgctttcgggttaggcacgcagccctcatggttgcaaacaaactaaaagctgtttgattgcttactcaggttcgctctgggatttgctgtggctcctttcctcttatcgcttgttcccctgcatgtttacctcattcccaggagactgagctgcagggcccagctgataagggaactgttgcccagcagccagtcaggaggcaggcactcctgagccaggtttttgttttgttttcccgattttgtttgccgatggacaggtcagatacgatacacctggctggtaatgagacgcctgagctgagcctggtcacgttgctaatgtcccactgcacgcacctggctgtctctggtttaaagcgagacagctgtgggagagaagggtcaaagtcccgggtaaccttctgttgtctgactctgaatggctcccctttctgaagccttgccaagtgtattagaacatggatgtggcttagaacatgtgttttatgttcttgctgcaatcccagattggaatgtttgcccttggcatgtccaaagatgacacaggtgatttggaaatttacatgtactcatgcaaaagaagggtgagataatgacttgccccagtgtggaactggcggaacagtgtgtgtgattcttattgtgaaacattctaaatttgaggctcaaataataaatttagtcagatttaattttttaaaaaaggtaacttagtccacaatcctaatattgccaacactcatggaaattgaatccttgagtagatatagtacttccctttgaagtggcccatagggagttttgcatcctaaaagggaatggtatatcctgattttaaaaagccaataattacatccatcaagacaatataaagaaataaacaatgaaaatgcttttaggttgactatttagtttggggaacagtgtatgattgcatttatttaatgattttttatgcacatttaagaatgattaaatgagtattttataacatatcatacatatattgcacacatatgttctgtgcacatgcttgcttgcctgtgcacaggtagatttggtttttttttttttcagaagacatgatcttggttttcaggttcccatttctaaatttccttctctcccatcttgagctggggtcaagcaagttgagggaagtatttggcaaccctgcattagcctttgggaacctttaaaaaatattctggcttcaaaaatactccatatttacatctttggtctatctgaagtaaagccgtgatggtgtgcgtaagtgaaacaggtgcaaaggggcaacaaaaagggcgcctctctttgtctttgtgtcgcaggcggagatggacatggtggcctggggttggacctggcctcagtggagcagcacattaacagccaccggggcatccacaactccatcgcgactatcgctggcagctggacaaaatcaaagccgacctggtacttgtctgtgtttcatttagagtcttcaaaatatctaccgaaggatcgtgtaattactcaatcccagggagtttttctgaaacattgctattatttctttcccagaagactggaaatgtttagaaatcccactcttaaatggggaagtggaatcagtagccctattagagattatgttaacacttgaagagggttaaaccagaggctgaggttgtgcaaacactcatttgcagtttgtgaataagtctcttaggggtggcagtttgtttctgcggtaagcagaacatctttttgaataggggaaatgcaaagtcttatacagtagtttgtgtcattggtgaatcctttcctaggtggtaattaaaacatatttctactgagcaaagccatatgtcatcccgacacccgctcccatgctgaaaaaagtcgacttgaaactgggttgagaattacagcataaaatcataactgatcttaagtgcttagttcccgcaggtctctacacttgtaaatcactaaactttttttttttttttttacctgagacatagcttctcatcctcatttcttcttctggctttttggggcttacttttgtccacctggcccctgaccaactttctccttcatttctctaagacctagggaatcctaaatgatgtcttaaactttaagacaattttctaacacgtgagtctttaagtgaccctgatctgggctttctttgtggagacggtgctgccaggccagcaagggtttgctttccaaccgcctaggaaaaatccccatgggtgaaatatctcatagagctagtaattctttctttctatggagggatctgggccagtatctgaagaaaaggaggcttagaagggccactcttttctatacaatccacaagggatttatatctacctgctttttgttgtcttctagcgcgagaaatctgcgatctaccattggaggaggagtatgaaaacctgctggtaagctgatttatttctcaagtgcatcgacttctgttgtttccaattcaattcagttcaagaaatatcaagcacatcctggcggggaggccctgttcatcgatgctaatgttgttgctgctgctgagtttcctttagaagtgaattttaaagttgttttcttttctttttttcttttaagtagagacagggtttcaccatgttcaccagttaaccagggtggtctcaaactcctgacctcaagtgatccgcccgccttggccttccaagtgctgggattacaggcgtgagccactgcgcccggcctaaaagttgttttcagaagtcgtccctactgctgttctgttttcaagttgtgtcacataaatggcacttgttaagtacttcagttgaagcaagaaaacgttgccacttgtgaattgtggtcttttttacgaagtgtaagaaaaataaaagttatttttctcaagatagaggtctaccagatcgtcatcacaattttatacactcagtcatatcagttacttgattcataagaggagagatttccattcttttgcctattgtgtcatcatatctttactttttaatgtttccttgttggcaatgatactttttaaatatgtcactcgtggtgacacagtgattttcctattgggctggggtgtgacttatggcacttgaatttttggggagaaggtaggaaaagcttgatttctctaacagtccattttccccctatagtccaaaactaattattgatgggtacaaaaatacagttagatagaaggagtaagtttaatatttgatagtacaatagggatattatagttaatgataatttattgtatatttcaaatagcttgaagaaaatatttgtaatgttcccaacacacagaaaagataaatgttcgagggatggatatcccacttatcctgatttgatcattatacattgtatacatgtgtccagatacatgtgtacccccaaatatgtacaactatatcagtaaaaaataccaaaaaaagaccttattagaagaataaaaaaaatttaaggccaggtgtggtggctcacgcccataattccagcatttggggggccgaggtgggcggatcatctgaggttgggagttcgagaccagcctggccactggtgaaaccccgtctctactaaaaatacaaaaattagcaggacgtggtggtgcatgttgtaatcccacctactcgggaagctgaggcaggagaatcgcttaaacccgggagggggagttgcagtgaaccgagatcgctcatgccactgcactccagcctgggagacgagagcgacgtccgtctcaaaaaaaaaaaagttgctgccttcttgttcattgcagatttggatgggtctttcccataccaggtggtcagtgaatgcacaaggttaacatttttcctatccgtgtgatttttttttaaagggaccacaggtttaatctttaaacctgcagagaacaccagtcactgctattgttattttaatgctgcctttgaacctcctgtgcagaaagcgtcctttgagaggatgatcacctgcgacagctgcagaacatcattcaggccacgtccagggagatcatgtggataatgactgcgaggaggaggagctgctgtacgactggagcgacaagaacaccaacatcgccagaaacaggaggccttctccgtaagttcaccccacgcggctgtagatgcttgtcttgacctgttgccttgaagagctggggtctcggggaatgattggtctattaataatttaatcaccacttgcaattcagccttctttgaaatggtcgtgaaaaatccttccttcctgaaaactctccgtgtggaggccattatccttagcaaacttatgcgggaacagaaaaccaaataccaatgttctcacttaggagtgggaactaaatgatgagaatacatggatacatcgagggcaaaacacacactggggcctttcggagggcagagggtggaggtggaaggagggagaggatcagcaagataactaatgggtactaggcttaatcgtgggtgatgaaataacctgtacaacaatccctgtgatacaagtttacctgtgtaacaaacctgcacatgtatccctgaacttaaaaaaaagttaaaaagaaaaagaggggcaataccttgtttaatatcccagaagaccgtagttgtttagagaggataagaactggtacgttcagataacccaggatgtgtgtggcactgcagagggtgggtggaagcctgggattagaaaacctcaggatggatgtagctcttctttcctctgtgtcatcttgagtaagcctccgccacatcctctcctgtagcaaacatccttttcagcttaaaaatgctgtgattcttgaggaaaacagcgtgattctttggcattgttcatttccaaatgcagttttgtatttcacttttaaaaagtactgtgggggtgatggaagtttaatgatacttgctgcaaaggatttcttatttcttcattcacagatacgcatgagtcaactggaagtaaagaaaaagagctcaataagctgaaacaagaaagtgaccaacttgtcctcaatcagctccagcttcagacaaaattgaggtaggcttcatgaggtttatatttttgttagaaaaaaaaaacttttcataaagtaagactaaccaaatgagtaattcttatatgacttaaagccgtccaactttattttctattttgggatcaataccctacaccaggggttggcaaactcttttaggaaaggaccagacaatcagtattttagactttcaggccatttggtctctgttacaatacttaaccctgctattatagtgcagaaggaggcatagacactgtgtaaatgaatgagtggcctgtattccaataaaactttatttacaaatagaagtgggccacatgtggcccttgagtatagtttggtgaccgctgccctagactgccatctttgggccacgctcaaggctgacatagctggtaccactggtatggccatactgcttgttaaaaaacacagaaagttccatatcattggtaagaatcactgtcttgagccccctaagccctttgcttggatgcctcgaacctcccatgattcagcaatcctccaggaacagggctcggtgtggcaaagggatgccactccagtctagccccagtgacagttctgattggtcagtatctctgctatttgggtgatacatatttgactaagactcctcatggtgtctatttgtgaaagctgattttaaaatttagttttgacctaccaagagatatatggtgagaaattctctttccaacttttagaaaaatatctgcttgattagaatgagataaaaactgcttactagctttcatgcaggctcacctatctcttggtgtcatgcatctgtacaactgagctaggctaagacagctgacattttcttgtttcaggcctaatggacactctgcagacgcagtggagttggattcttcagatcaccaagtgcattgatgtcatctgaaagaaaatgctgcctactttcaggtttttatatttagtgataattttgttgtatttaggtcttaatacctaatcttttgagtgtgttttataaagcactgaaaataatcttaaaatgttgcataaatcctcttcattgattttgagtgcagagtagcatagatttgcaacttgccatcagtcctacaaatagtttcccgctgccacatacctaaatactttctgcacgattttttcctttagccacctgtcaaagagatgtttagggatgacaatccttgaaacagaatactagatgaaattgcttattgagttgctgttcattcactgatcactctcatccttcacgttttttgaagaggcgcagtctactgaagcatacctgaaggggctccaggactccatcagaagaagtacccctgcgacaagaacatgcccctgcagcacctgctggaacagatcaagggctggaggtatcgtctcagacccagaacctcagcagctgtgcctgatcagggagataaacacatgccttggatgcagttggctctgattagtattattgtacaatgcacgcccagagcaagcaagcattttcttcagcttccagtggcttttctcaaaattaacttctttacatgccaactactcttgacagttacttttgcttcagtctgggcaattggttgaaaataagaacaggagaacattacttcacatgacaattcctttgggaacgcatacttcaaattttatcagcaagccctttcacacaaggatgttcttccctgcccacttaattcctgcctgcatagcttctgagagtgttgtcatgaaaggttctcatgtttcctgccgacgaatttgtgattttttacattgatgcaactgcagtgatactcagtgtgtcatgtagctacattaatgcaggttgaaaactcctctaaaactcacagggtatctatgtttaagtatgattttattcaccattgcagaagaacgagagaaaatccttgaatacaagcgtcaggtgcagaacttggtaaacaagtctaaaagattgtacagctgaagcctcgtaacccagactacagaagcaataaacccattattctagagctctctgtgactacaaacaagatcaggtgtgtactcatttagaatgatacaaaagtttccctgtctttacacacaaatttttgtccatcaagaaagcaacatttaatctagagtcaataatcaccacagtcaatgtctttgatctatgaaatcagcagctatggaacaaaagcgcagctctgttctgaatcatatggtagttgtcaataacaaggacagtagttatttttagacttttaaaaattcgcaaggcttaatacttttcttctagtatgtcaaagttgtctgtgacactctcatctttaaatttctgataaaagaaatgagaaatgatgcttttatgttgcataaaagtgaatgtctctcactatgggtgacacagtgagaccaaataaataaataaaatgtactcacttcatgtataccttttaggctcacatgtattatttaaagcatcggtattgttggttgtatgatgatcagcttcatttgaggggaaaaacgtaaaagctttaataattcgcatggttcatctctgtttccatcattgagaaaaaaaataaaaacacatacttatgaataaagcaaaccctggggttgcttgccttacagaaaatcgtgcataagggggatgagtgtatcctgaggacaacaacgagcgcagcaagtggtacgtgacgggcccgggaggcgttgacatgcttttccctctgtggggctgatcatccctcctccgaacccactggccgtggacctctcttgcagtaagtcatccaagttcccaaagccacgcatgcacgcatgaatgtgagggcagaggaaagggcaggtgtttatacctgaagcttagacacacgatgccttgccataataaacacctttaaaaaaaggaaccttgtgaaggtcaccttcactttgtcttgcaattttatgttgaataacagtcgttattgaagaataaaagggaatatctggccgggtgtggtggcttatgcctgtatcccagcacttggggagaccgaggtgggcggatcacctgaggttaggagtttgagaccgcctgaccaacatggagaaactctgtctctactaaaaatataaaattagccaggtgtggggtacatgcctgtaatcccagctactcgggaggttgaggcaggagaattgcttgaacctggagggggaggttgcagtgagctgagatcgtgccactgcactccagcctgggcaacgaggcaaaactccatctcaaaaaaaaaaaaggaatgtctgactgtagtggggccagagtgaaaatacttgtcatgcacttcaaaggcatcattttaaggttctccttttcttagaaaatcattgttatacatgtagctacaaatataaaatgcctttaatatcaatattcactcattgtagaagaacattcgtttaacaggttgtccatggcagattcctttaaaccatttagtatcgaatcttcaaccacacactgaatagggagagtagtgtagtaagctgctgtgtgctcatgacaagctttgggtcattggcatctaatgcacctgccatcctgccttagacctctgtcaattcaaagttgccgaaaaacaagacaacaacaaaaagttgtagtatatatgtcagccaataagtagataattcagaatgtacttttggggagtaaatgaatccaaatccatgaactgttttaaagttatacctctacctgttactttatcagtgactgttgtaggtttttgtgcagtggttgagcgtgtccaggtttcccatttgggatgaagtgtgaaagcctggctctagcatgtttccctttgtgcctcttaggattgagcagtactacgaagccatcttggctctgtggaaccactctacatcaacatgaagagcctggtgtcctggcactactgcatgattgacatagagaaatcagggccatgacaatcgccaaggtatgtcctcagggccacttaggctgcctggaggggggcagcgctgccccccgcagtgcctgtgtccaacagttcaaccttcttgctgtgtagcgtgcttttgtgtctcgtcaagcaagtcagctcagccctccttagaggttctggtctgtcaatagagaacaggagggattagcatatggctgattatgagagaaagaagcaatactaatcaggtggcctgacaagcaagccagaagtgcctgtggaaaagtcatgcactcctgtaagatctggaccctatgctcctttgatgtaatggaaagttaggtcataaaggattaactgggttcacaaaagtaaaaggtgggatagaattcttggaagagcacccaaagcattacttactcaaatcagttgttttcagatcatggtctgaagaatcctagcaggagagggagatcctttagagtgacagggatggaagtgaggagaggggcacagaaagtaccttttggggtcccccgaccctttttctctttgtagttggagcagctttgctgggctctgctttacatttagggctttgaataatatttcgttgaagaaaaatattctgtaggcaaaaaaaaaaaaaaaaaattagaacccattcctgtggctcttgggaacaatgtctaaaacctaaaagaccttttatatcttatgagcctgtgatgagtgttgctttgagtcccatctagtgggtggcattttttggccaatcttcttgattgcattgtggggcagtcataaatcccaaatcacttctgcctgtctccttcagctgaaaacaatgcggcaggaagattacatgaagacgatagccgaccttgagttacataccaagagttcatcagaaatagccaaggctcagagatgtttggagatgatgacaagcgaaaatacagtctcagttcaccgatgcccagaagcattaccagaccctggtcattcagctcctggctatccccagcaccagacaggtcggcttgggacatctttctctttgtatcaacctccataccattttaaaaagaaaggagtttgcataaaactggtttcagaaccatttctctaatgctatatagccagtgttcttcgtgcactaaattttcagaattgattctgaaattcaaggaagaaggtatacttttaggtagtatggatgttttttgaggcctagcaccttgatactaggtattctctgatttttgtggccctaacttctttttacagtgaccacaactgaaatcctcatcatggaacctgccaagatgtcaaccataataaagtaattgaaaccaacagagaaatgacaagcaagaaacatggatgctgatggagctgcagaagattcgcaggcagatagagactgcgagggcaggatgactctcaaaaacctccctctagcagaccagggatcttctcacacatcacagtgaaaattaacgagcttaaggtaggtatctgctagtattttgcctggttacctgtatatttttatttacctgtaaatgaataaaaaaaatcctggtttaaatgtttgtagcaaaaatattaactttcaagaaaacaggcttctggcaggatttccttatgtattatgttccaaatttgtagacggttatcaggctgggggttaaactgttcgtttgtgtgttgttgatcaggctaccgtccatctcaaaagttttcacaaccattaatttggcttcttgcagagaaaacctatgatatgggttagacagggggaatgatctttatttgtagacatgacactgacagaagagatttggttggtgagatacgatctcaaagccatagacagagtgtgactatggccaggtgtgtcagctcctaactcagtgatgttttctgctcaaccaagcctgggcacactgcctggaaggcctaaatagagatattctaagaggatcacatttacagtgctaatgaggccaactcaagaaagaaatagaaggtcaactcctctctcttccttgaatcctttacttttagtgactttttaagggcaaaaatgatcataagattcacacagctacaatgcagagtactaactctgtgtgatcagtatgccaaaattggaatgtagttgtgttgcttaatgaccggggcacttctaagaaatgcatggttaggcgattttgtcatgcaagcgccatagagcatacttacaaaacctagatggtatagcctactatacacctaggctacaaacctgtagggcatgtgacttcctaaatactgtaggcaattgtgacacaatggtaagtgtgtatctaaatatatctaaagtcgaaaagatacaataaaaatacagtattataatcttacgggggctggatgcaggggccatgcctgtaatcccagctacttgcttgagctcaggagttggaggctgcagggagctatattgtaccactgtactccagtctgggcaacagagcaagacccttctctttaaaaaaaaagtgtgtgtgtgtgtgtgtgtttatatgtatgtatgtacatatgtgtgtgtgtatatatctaagggaccaccattgtgtatacagttcatcattgaccaaaacatcattagtagacacagactatacacacacacagtggggtactatttacctttaaaaaagaaagagatcctggggcaggtgcggtggctcacgcctgtaatcccagcactttgggaggccgaggcgggtggatccaaggtcaggagttcaagaccagcatgaccaacatggtgaaaccccatctctactaaaagtacaaaaattagctgggtgtggtggcgtgcgcctgtaatctcagctactcaggaggctaggcaggagaatcgcttgaacccaggagatggaggttgcagtgagctgagatcacgccatgcactccagcctgggcgacagagcgagactctgtctcaaaaaaaaaaaaaagaaagaagagatcctgccatttgcaaaagcatggatgaatgtgggggacattatgctaagtgaaatcaccagacacaaatactgcttgatttcacttatgtgtaaattctaagaaaaaagttgaagcagggaaacagagagtaggatggtgattaccggggtggggagggaggaggaaatgggagatgtaaaggatacaaacttgcatttgtgtgggatgaataaatctagagatctaaattcgcgcaagactacaggtagtaatcttgtagtgtatattgaaattttgctgagagtagatttaggtgctcttaccacacatacaaaaaaagataaccatggaagttgactgatgtgttaattacttacctgatgtaatcatttcactgtgtctatgtgtattaaaacagcatattgtacccttaaatatatacagtaataaaaagaatcagctaaatcaaaagagctttccttcattttgacagagtgtgcagaatgattcacaagcaattgctgaggttctcaaccagcttaaagaatgcttgccaacttcagaggttctgaaaagtactgctatttacagaatgaagtatttggctatttcagaaactggaaaatatcaatggtgttacagatggctacttaaataggtaaaccagctaacactaatctcatattttccttttctcaagcttctttttctgggtcttcatttctttagatgcttgccttacagtttctctgttactagagatttacttacatccttctgtgtttggagagcatgttaattccgctagcctcgcatgttaattccactattctgaactatatgttatcttagaactaagttatgctctaagggccagaacttgagaattcttcagcgaatcaaaatgttggtctgaatcacaatagaccaaaaaacagacaaaataaatttttatctgcttgacgttgttccctttcattactagctgtgagaggcaaatcttcacagactaattatgcactggcaattttatgtgcttcttttgctctttccagcttatgcacagtaagggcactgtccaggctattctccaaacagaagacatgttaaaggtttatgaagccaggctcactgagaggaaactgtctgcctggacctggataaagtggaagcttaccgctgtggactgaaggtacttgaaagcttataacagtggcccaacttacaggaactaattcagatctgagctcccaatataaagcctcactgggttttcatgagttttgaggattattgggtttcagtggccacacggttgacatcagttgtcatctctgtaactctgttttccagactgtgttagcaggaactaataagaaagtaattcgtgatgggattagtttggggaatgctgagttaaactggtttcttactgtgggacttcttagaaactttaatatgttcatattattattataacaggatagcacaagaacaagattattggaacaaatactgggaaatgcaattcagtaaatatatttccctgattgactgttaacactttaaattatgaatattctaaagtgttttataaactttgccgccaatttggtgacttgtagtgtagcatacaatgggagaagggattaatttgcaatcttttttttttcatcttgcagaaaataaaaaatgacttgaacttgaagaagtcgttgttggccacatgaagacagaactacagaaagcccagcagatccactctcagacttcacagcagtatccctttatgatctggacttgggcaagttcggtgaaaaagtcacacagctgacagaccgctgcaaaggatagataaacagatcgactttaggtatgccagcctcctcccgctccttccccacttctccccttttggttgttcacaagataatgtcacttgaagggaaccactgaagaaaaagaggttttgttttttgtgtaagttaggcgtaacagatgctcttttcatggactgcctgatgcagctttgttagaaatggaaggagaatgcatcacgatagccaaccctgtgcaggccggtgccatccagggtcttagagaaacggcagaagccctttagccagctcttttgtgtccataaactcttgttatgactcttggaaggagtagctgccttgagttagcattctccaaaatttatgaaaattaaatcttagaccaaaaaaaatgcctttctgcaaataagagtttaaaaatctctggaatatgaatctgcctattctggaaattttatatgactggaatcatacaatagtagtccattgtgactggcttctttcacttagtatcgtgctttcagagttcatctgtgtgtatcatgtttcagtacatcattttctatttttttcatgtgtttttatgattgaataatttccattgtttggcagtgccacattttgttgatcttttcatcagttgatacctgagttgttccagtttttggctgtgataaaaagtgctgctatgaacattcatgtataagtttttattgggaatatgatcagttttcttgggtatatatcaagtgaatttctgggtgattctatgtacatattttaggaactaataagataatgattttattgtatctatttccccccagattatggacctggagaaacaaatcaagcaattgaggaattatcgtgataactatcaggctttctcaagtggctctatgatgctaaacgccgccaggattccttagaatccatgaaatttggagttccaacacagtcatgcggtttttgaatgagcagaaggtataagccaactttttgttcctagctgttttgagattaattgggtgtaattcatgttttcctctggtttttgtatcagtgctaggtttgaaatgatgaatatttaatattactaacccattttgtgaaggcttaaagaagcccagaggaaaagcaactgagatgtttacaaggaaatgcaaattatgaacatagaaatacgtgatattgttctcttcatgttatcataaattatctttataaattgaggggataggccagaaaacaggctgactagaaagtaacctcttacagatagtaagttaaagggcttgctttcttctctgaatggaaaaaatgctcatctcctaagctgtaactataaaaatatgagacagtacatgtagtaataaactgaaaaaagggtacaaataacagtggtaaaagagtgaaatccatttatttaaaaatatttgtatgcattaacattggtaaatatttcactttttgtatagacttgcacagtgaaatatctggcaaacgagacaaatcagaggaagtacaaaaaattgctaactttgcgccaattcaattaaggtatgttggtttcataaagaatgttggtatttcaccagattattattaactgcatgacttgctgatttgttgtaaagagtatacacttcctgaggtagcaattacggtctgtatatattcttttctgaacaaaccataaaaattaaaaatctatagcttgaattcattccacattggcagtatccatttgaatggctggtttctattctttgatggtggtaggtgctgcattctccatttagcatacaaagatgtactgcttggtttaataaggtgtttgtttgtttgtttgtttgtttggagagagtttcgctcttgctgcccaggctgggtgcagtggtgtgatctcggctcaccgcaacctctgcctcctgggttcaagtgattctccgcctcagcttcctgagtagctgggattacaggcatgcaccaccatgcccggctaatttatatttttagtagagacagggtttctccgtgttggtcaggctggttttgaactcccgattcaggggatctgcccggctcggcctcccaaagtgccaggattatgggtgtgagccaccagctaatgtagtattagttgcttggccactagtggcgcaaagtctttggagtgggcaattgacgtgcagcccaatgatttaaaactgtggaactgtagctgttagtgatgctttttaagctatgaaggacacttttcttaaacttcattatgctgcaggattatgagctccagctggctcatacacctcaggactggaaactctgctgaacatacctatcaagaggaccatgattcatccccttctggggtgattctgcaagaggtatatatgtcatcacatatctcttaaaacctcccctccttctgcttcttcccttttccctgtctcctgcctcttcccttttccctgtctctgcctgtcttccttaccattgctgatttcatcccattacagggtaccactttaagaggttaatagcaggttatgtgccctccagtgtgagtcattgatgtatgatacattttcagaaagatcaggaatctgttatttagagtctttgtagaaattgggcttaaatttctgggtttgagagacttctaaaaagtggaaaatacagaaatttctaaaagacagcctcttctcaaagattcagagactatcgtacctgtcagatggtttaggggaaacagcctggagagatgagaatggatacatttttggccctttgttttgctgtactttcttttgctgattttggaatgaacacctaaagaagagaattcactctttataatttcactattttagaaaacaaaatcggtcaaatacataggactttttttttaatgcaatatctttttctttctttccttccttttctccaagctgcagatgttcatgctcggtacattgaactacttacaagatctggagactattacagttcttaagtgagatgctgaagagtttggaagatctgaaggtaatttatactgtcttttctgtagcatcaaaaaagaaaatagaatagaaccttattattacttccacattataacatgatttggacacatcctggtgaaactgtatttcctctaaaggtttagtgtaatactgcttgttgtaagtctggggttacttccatgctccaatacgctgctttaaatgaacttaagtaatgtcataatattgcaacaactttgccaaacaaaagtcacttgatttaatgtttggttaagaatttgctttatttctctgtgttaaagataacatcttggactaggtatatttgaatttttatattcagtgattgttccctttattcctcatttatgatgcttaaattgagattatatgaaacttattttaatgtaaacttgaaataaagggaatataatttatgaaatcataagctttgattttgaaagaaattacctcattttacagatgaggtagctcagactcaaagataataatcatttgctaagatcatatgagcagctggtgcaagaattatgatgagaatccagatttttgaatttttgcctagtcactctttgcatgtatgtctgtgtgtgtaaagagaaatgagatgcacattggtctgggaggggaaaagtactgcttctttcttggaatgtgaggtgtttttttttgacataatctctgatttcattccacagctgaaaaataccaagatcgaagttttggagaggagctcagactggcccgagatgccaactcggaaaactgtaataagaacaaattccggatcagaacctgcagaaataccaggcagagtgttcccagttcaaagcgaagcttgcgacctggaggagctgaagagacaggctgagctggatgggaagtcggctaagcaaaatctagcaagtgctacggccaaataaaagaactcaatgagaagatcacccgactgacttatgagatgaagatgaaaagagaagaagaaaatctgtggaagacagatttgaccaacagaagaatgctatgaccaactgcagaaagcaaggcaatgtgaaaaggagaaccttggttggcagaaatagagtctgagaaagccatcaaggagaaggagtacgagattgaaaggttgagggttctacgcaggaagaaggcacccggaagagagaatatgaaaatgagctggcaaaggtaagaaaccctataatgaggagatgagtaatttaaggaacaagtatgaaacagagattaacattacgagaccaccatcaaggagatatccatgcaaaaagaggatgattccaaaaatcttagaaaccgcttgatagactttcaagggaaaatcgagatctgaaggatgaaattgtcaggctcaatgcagcatcttgcaggccactgagcagcgaaggcgagctgaagaaaacgcccttcagcaaaggcctgtggctctgagataatgcagaagaagcagcatctggagatagaactgaagcaggcatgcagcagcgctctgaggacaatgcccggcacaagcagtccctggaggaggctgccagaccattcaggacaaaaataaggagatcgagagactcaaagctgagtttcaggaggaggcaagcgccgctgggaatatgaaaatgaactgagtaaggtaagaaacaattatgatgagggatcattagcttaaaaaatcagtttgagaccgagatcaacatcaccaagaccaccatccccagctcaccatgcagaaggaagaggataccagtggctaccgggctcagatagacaatccacccgagaaaacaggagcttatctgaagaaataaagaggctgaagaacactctaacccgaccacagagaatctcaggagggtggaagaagacatccaacagcaaaaggccactggcttgaggtgtctcagaggaaacagcagctggaggttgagctgagacaagtcactcagatgcaacagaggagagcgtaagatataagcaatctcttgatgatgctgccaaaaccatccaggtaaaaacaaggagatagaaaggttaaaacaactgatcgacaaagaaacaaatgaccggaatgcctggaagatgaaaacgcgagattacaaagggtccagtatgacctgcagaaagcaacagtagtgcgacggagacaataaacaaactgaaggttcaggagcaagaactgacacgccgaggatcgactatgaaagggtttcccaggagaggactgtgaaggaccaggatatcacgcgttccagaactctctgaaagagctgcagctgcagaagcagaaggtggaagaggagctgatcggctgaagaggaccgcgtcagaagactcctgcaagaggaagaagctggaggaagagcggaaggcatgaggaggtcgctgaaggagcaagccatcaaaatcaccaacctgacccagcgctggagcaggcatccattgttaagaagaggagtgaggatgacctccggcagcagagggcgtgctggatggccacctgagggaaaagcagaggacccaggaagagctgaggaggctctttctgaggtcgaggccctgaggcggcagttactccaggaacaggaaagtgtcaaacaagtcacttgaggaatgagcatttccagaaggcgatagaagataaaagcagaagcttaaatgaagcaaaatagaaattgagaggctgcagtctctcacagagaacctgaccaaggagcactgatgttagaagaagaactgcggaacctgaggctggagtacgatgacctgaggagaggacaagcgaagcggacagtgataaaaatgcaaccatcttggaactaaggagccagctgcagacagcaacaaccggaccctggaactgcaggggctgattaatgatttacagagagagagggaaatttgagacaggaaattgagaaattccaaaagcaggctttagaggtattcacaaatattgatcacagcttcactgtttctcaaattattcatcacattattatctcatctgaactggctctttctgcttaaatagatgcttatagaaaatctaatttttctttttattgctctacacttcctgtcataatccaggtaactgctttaaaataatttcaatgctgtgtgccctgctttctttaattgcatcaaatgctgatctctgggtagcctgtgtttggccctgcttttaagacactaatacatgtataacttcctccgaatgttccattctacttcttagaagttagctctatttagtgagctatgacatacatttgtaatgaaaattttcttaaatagaagccatactaagtgtttccctatgcaatttttaaaacactttttcttttgcctgcttagatgattttttgcatggattatttagtgttcgcttttgatcatggccctagtgtgtttccttttgtttgctttccttctcctaacccttaatttaaaaataacttatttaacttctacagacaatattgtgtgtggctgggttggtgtgtgtgtgtgtgtgtgtgtgtgtgtatatctatatattattatataattatataattacataatatatatttatctataatatatattttatataatattatcttcatatatttgtattgcttcattaagtatgttcatctagctgtaacaggtgagagtaggtgtagcaggtatgataacctgaaacaaaactccccacattttttcaaagcataatattgttaagagtaagacaggtctgcaacttacagttccttctatagaaaaaaatagtagtatgaagccatttattgaagtggcaacatatacagaatttttcccacaaatttgtaaataacaagctcacagtgtatccagggacaatatagaaagaaaaaataagcaaggctttttttttaaagatagatacacaaaagaaagttaagtcgtgatagtaatatgatatgattcaaacattattttttcccatttctttcttcttcaattccaggcatctaataggattcaggaacaaagaatcagtgtactcaggtggtacaggaaagagagagccttctggtgaaaatcaaatcctggagcaagacaaggcaaggctgcagaggctggaggatgagctgaatcgtgcaaaacaactctagaggcagaaaccagggtgaaacagcgcctggagtgtgagaaacagcaaattagaatgacctgaatcagtggaagactcaatattcccgcaaggaggaggctattaggaagtagaatcggaaagagaaaagagtgagagagagaagaacagtcttaggagtgagatcgaagactccaagcagagatcaagagaattgaagagaggtgcaggcgtaagctggaggattctccagggagacacagtcacagttagaaacagaacgctcccgatatcagagggagattgataactcagacagcgcccatatgggtcccatcgagagacccagactgagtgtgagtggaccttgacacctccaagctggtgtttgatgggctgaggaagaaggtgacagcaatgcagctcatgagtgtcagctgatcgacaaaacaaccttggacaaactattgaaggggaagaagtcatggaagaagttgcttctgaaatccagccattccttcggggtgcaggatctatcgctggacatctgcttctcctaaggaaaaatactctttggtagaggccaagagaaagaaattaatcgcccagaatccacagtcatgcttctggaggcccaggcagctacaggtggtataattgatcccatcggaatgagaagctgactgtcgacagtgccatagctcgggacctcattgacttcatgaccgtcagcagatatatgcagcagaaaaagctatcactggttttgatgatccatttcaggcaagacagtatctgtttcagaagccatcaagaaaaatttgattgatagagaaaccgaatgcgcctgctggaagcccagattgcttcagggggtgtagtagaccctgtgaacagttctttttgccaaaagatgtcgccttggcccgggggctgattgatagagatttgtatcgaccctgaatgatccccgagatagtcagaaaaactttgtggatccagtcaccaaaaagaagtcagttacgtgcagctgaaggaacggtgcagaatcgaaccacatactggtctgctcttgtttcagtacagaagagaagcatgtccttccaaggaatcagacaacctgtgaccgtcactagctagtagattctggtatattgagaccgtccactgtcaatgaactggaatctggtcagtttcttatgacgaggttggtgagagaattaaggacttcctccagggttcaagctgcatacaggcatatacaatgagaccacaaaacagaagcttggcatttatgaggccatgaaaattgcttagtccgacctggtactgctctggagttgctggaagcccaagcagctactggcttttagtggatcctgttagcaacttgaggttaccagtggaggaagcctacaagagaggtctgtgggcattgagttcaaagagaagctcctgtctgcagaacgagctgtcactgggtataatatcctgaaacaggaaacatcatctctttgttccaagccatgaataaggaactcatcgaaagggccacggtattcgcttattagaagcacagatcgcaaccggggggatcattgacccaaggagagccatcgtttaccagttgacatagcatataagaggggctatttcaatgaggaatcagtgagattctctcagatccaagtgatgataccaaaggattttttgaccccaacactaagaaaatcttacctatctgcaactaaaagaaagatgcattaaggatgaggaaacagggtctgtcttctgcctctgaaagaaaagaagaaacaggtgcagacatcacaaaagaatacctcaggaagcgtagagtggtcatagttgacccagaaaccaataaagaaatgtctgttcagaggcctacaagaagggcctaattgattatgaaaccttcaaagaactgtgtgagcaggaagtgaatgggaagaaataaccatcacgggatcagatggctccaccagggtggtcctggtaatagaaagacaggcagtcagtatgatattcaagatgctattgacaagggccttgttgacggaagttctttgatcagtaccgatccggcagcctcagcctcactcaatttgctgacatgtctccttgaaaaatggtgtcggcaccagcagcagcatgggcagtggtgtcagcgatgattttttagcagctcccgacatgaatcagtaagtaagatttccaccatatccagcgtcaggatttaaccataaggagcagctctttttcagacaccctggaagaatcgagccccattgcaccatctttgacacagaaaacctggagaaaatctccattacagaaggtatagagcggggctcgttgacagcatcacgggtcagaggcttctggaggctcaggcctgcacaggtggcatctccacccaaccacgggccagaagctgtcacttcaggacgcagtctcccagggtgtgattaccaagacatggccaccaggctgaagcctgctcagaaagccttcataggcttcgagggttgaagggaaagaagaagatgtcagcagcagaggcagtgaaagaaaaatggctcccgtataggctggccagcgcttcctggagttccagtacctcacgggaggtcttgttgacccggaatgcatgggaggataagcaccgaagaagccatccggaaggggttcatagatggccgcgcccacagaggctgcaagacaccagcagctatgccaaaatcctgacctgccccaaaaccaaataaaaatatcctataaggatgccataaatcgctccatggtagaagatatcactgggctggccttctggaagccgcctccgtgtcgtccaagggcttacccagcccttacaacatgtctcggctccgggctcccgctccggctcccgctcgggatctcgctccggatctcgctccgggcccgcagtgggtcccggagaggaagctttgacgccacagggaattcttcctactcttatcctactcatttagcagtagttctattgggcactagtagtcagttgggagtggttgctatccttgacttcatttatatgaatttccactttattaaataatagaaaagaaaatcccggtcttgcagtagagtgataggacattctatgcttacagaaaatatagccatgattgaaatcaatagtaaaggctgttctggctttttatcttcttagctcatcttaaataagcagtacactggatgcagtgcgtctgaagtgctaatcagttgtaacaatagcacaaatcgaacttaggtttgtttcttctcttctgtgtttcgatttttgatcaattctttaattttggaagcctatatacagttttctattcttggagataaaaattaaatggatcactgatattttagtcattcgcttctcatctaaatatttccatattctgtattaggagaaaattaccctcccagcaccacccccctctcaaacccccaacccaaaaccaagcattttggaatgagtctcctttagtttagagtgtggattgtataacccatatactcttcgatgtacttgtttggtttggtattaattgactgtgcatgacagcggcaatcttttctttggtcaaagttttctgtttattttgctttcatattcgatgtactttaaggtgtctttatgaagtttgctattctggcaataaactttagacttttgaagtgtttgtgttttaatttaatatgtttataagcatgtataaacatttacatatttttatcataggtctaaaaatatttgtttactaaatacctgtgaagaaataccataaaaaactatttggttctgaattcttactagaaggtggtcttttgaagttagtcctttggtacttctcagatgcctgtcatgtacccgatggagtccttggaaagaaggcctgtgtaagaggccagcctggaggtcaataacctgttctagtttattctggacattgagtaccaagagcattggcaaaagtcatcatcatagcattgaaaaaacatgaagttgctaagatgcttttgggtatcctcaaaatagatagtgtttcactttgtcctgtaagaggaaagaattgtcctgaacccatgaaaatgatttctgaagagttcttggctctctgttgaaggacaaggaagtaaagcctattcctttggatcaaagagaaactactgaaattcacacatttgtcattagattacatgacttcactgaatacccaccatgtctagtattgggttaggtactatgaagactgatagaatttacaagcccccgacaacaaagcattggcaatatgggtggggacagaaacagaaaagcaatcagtgggacaactttcaaatgtcagcagtatatattaatacaaattttatatacagatagaaaataggaaaacatgctaattgtatagaacaaaaatcaagattagattattattgggggcttttggtacttagggtgaaagtcacctccattctcattgcatgggctattttcctccacagcactcttttcttccttatttcacctcttcttccttactccctctccaatttggaggagttgaaattaattttatgcattaaatactgagttcgcgtgccatgcatgtgccagaagccatggagtctgtgctagaaatacatggtgaaaaagagccctcataatcaaaaggaagaagaaaatgtggtaaatgctgtattgggaaaaatgaaggaaattccttatctagagctgggagactatattagtcacctcaccctgccataacaagatgccacagactggagcggcttaaacggaagtgtattttctcacagttctggaagctaaaagtacaagctcagatgcaggcagggctggtttctagtgaaacctggctcatgggtggctatcagtcttatcgattagagtacccacccctcctttatgacctcatttaactttaattacctcttagggcttatctccttatacagtcacattgtgggttggtacttcaacataggcatttttgagggaccaatccaatccataacagaggcctagcctagaacaggagtctggagaccactccaggaagtgatatcaaaacagatcagcagcatcagtgtagagcagttcctcgggctgaaacagtactagagagtacagtcaattgacaaatctttcctactccctccaggcttgtgccaatgtttcatgaagctctgagatgacatggggctgtatcctgaagagaggatatgtttgacgtggctaagttttaatttggttcacatatacaaacagggaaatatacactagaactttttatcggagtcatgtcacatcagaaatagtctcacatttttccagaccaaccagctaactatggaatgcaaataaaaagtaaggataccgggctgggcgcggtggctcacgtctgtaatcccacactttgggaggctgaggcgagcagatcacaaggtcaggagttcgagaccagcctggccatatggtgaaaccccatctctattaaaaatagaaaaattagcagggtgtggtggcatgtcctgtagtcccagctactcgggaggctgtggcagaagaattgcttgaacccgggagatgaggttgcagtgagctgagattgcgccactgcactccagcctgggcggcagagccagactcgtctcaaaaaaaaaaaaaaaaaagatactgtaggcagagtatgaatacattaacttcaactcctctcttaccagcttctagccacttctgtattttatggtgctgcctatttatagtttatgactatttttttaagtgagaaccgtgctatttgcctttagaaataattgttcaccaaaaattcccccacagttccttcacatgggtaaacaaagtgcaaaaggaaaccaaggttgacacttgggcttgaaaaaattttaaaaagtaatataaaatgggttagattctaggagtgaaaccatttggggaaactacaagggctaattccaggtgttgggtaggaaatgtacaaattaagcttgtgttatcaaagcaagaaagcattcaaggaccaatagggatacatgaaagaacagatggcttaatgtggcttccactggccacatttgggacaatttgagcatcaacaagattatgatgttaaaggagtatattatattgaattaaaaaaaaaccttaaatcaataacttaaaaacaccttgattcccatagtgaagcaaacactaaaatggaggtgtggaaagaatgcagttaataaacataaaaggcatgatactattgcggaatcacttataactcctaatgtacaacagattcagtgaaggactgtatcaaggagttggggaacaggttattcttatggactaaggtataatccacagattgcttaccaattcctaagaggaaaatgtactattagaatgagagatgtagccaccacctttaccaagtgatcaaatttagcattactaatataactgagtatgcgtccccgtgagttggcaacatctcttaggtagtattgcaaaagtgctcaaactgatctaatcatgagggaaacaaaatctgacaaatccagaatgagagagattctacaagacactggcctaggctcatcacaacatgtaatgatttaataatttaaaaaggagggtgaaggagctgatctggattaaaagagacaataactaattatagcttatgagttgaaaaaataaaatgctatagaaataattttggggacaatggggaaatttgaatatgaactgtataataaatattttatggacttactaattttcttaggtttgatcatgtattgcggttacacaggaaaagttcttattcttagaacatgcatgctaacatatttgggggtgaaaaatctgcaacttacttcaaagaattcagcaaaaatcattgggtggggctgtgaatgtggagagaagagacggaagaaatcaaacctggcaaaatgttaacaatgagctgaaggacggctaaacgaaagctcatgtactatttttaaaacttttctgtagctataagccgttttttctgaggaagtcgaggaggcgaatatctttctggaaaggccagagcaaatgcacgcaagagctgagaaaagattggaaacgcctctcaaaataacagtcccgcccttcccgggactcttccctataggctgttcagtcacgtggcgactgtggccccgcccacagctcccagaggcctgcgcgtgcggtctgcattcggccgcttcctcttggcgggtgggctgcagctatggagggcgagcctccacctgtgaggagcggcggcggctgcaggaggagctgaacgagttcgtggagagcggctgccggacgtggaggaggtgaccgcgtccctgggctgggacctagatagtctggatcccggggaagagaggcggcggaggtgaggagcgcggccgcggggccctttcggggactatcggcccggggtttctctggaagaagggagatccgcactggcagccgcggagggaagggcgaggagtcctctccgtgtgcagagccgcgatgggcgcctgggacccgaggggcgccgggggccctggagcaccctgacgtccctgggttccgggctggggcgcgcgaggaactcccgaaggctccacatgacctccagtgcggcgctcctcccgcgcaacttcgagtttaaagaaaaccgggggccggcgcggtggcgcacgcctgtaatcctagcactttgagaggccaaggcgggaggatcccttagcccaggagttccagactagcctgggcaacatggtgaaacctcttctctaccaaaagtcaaaaattagccgggtgtggtggtgtgagcctgtggccccagctatttgggaggctgggtggaaggatagcttgagcccaggaggtcgaggctgcagtgagccgagatcgctccactgattccagcctgggcgacagagcaagaccctgtctcaaaaaacaaacaaacaaaatccagaaggtgtgttgagtgaggagggaatggcagatttggtatttatttagaaaataagtgaagtgtctcagagcgctgcagagggattggcggtttgcattgtcatctgtcatacggattcgcagttgcaccagattcggtgtcaggagagctgggagtttgccagttcgcctttctgtgcttaaaattggacacttctgactgggacagcaccaattctaggattattaaaggttgtcccaagaggtggtaactggcaactcctgtggacattagaattgcttttttaaaaatgtagcaagtgtatttagagtgaacattcgtgatttttgtttttttgtggggtattttcggtggatgagaggaagggaagtgctccaatgtggggtaattcattatctttactattacttctggtttaccatgctgtgataatttctcctgggtttaagttacatgactgattcctcagaggatttaaaatatatttgatttctgtatataccattcattgtttattgtattaaaagcacaaggaaattaaaaaatctttaatattcatttagaggggtatttgaagctgggaattccacgagtggggcttaccagacccttccatacattgtttactcagcattgcggtaacattggatccttgtattaacgtttaaatagcactttgtttgccacttacattacttcatttaataccaaaataaccctatgaggtaggtatctttggccacattttatagacgaggaaaggaacaagaagtgataatttgtcgaaggatacactgctagtaaatggcagttaggatttccgccgtgttttagtactgaaatttagtgaacaacagtcctagttgtcatctgttcctagttgtccctagttcctagtcctcacagagctagtcctagttgtcacctagttcctagtcctagtttcacctagttcctagtcctcacagagcttattgtctggtggtgatgaggggtaatacggtaactgaaccattatattatcatgggtctgtgatgggtggggttggaattgctatagtaagtttattgtaggcggtggtggacaaagtggtggtcagcaaaggcttcctggacaaagtaattctaagctgataaataaaagtgagttgaattggctagggggttggcgggtgcggggagaagcatcaacagcatgtgtagaagttcagagacagggagtgaccagatcgggaagcccaagtagttaaggatagctagagcatagagtgtagagttagagtagaatggtgatggtggtagaggtcagatcttaaaggtccttgtcagccatattagaaagtctagattttttttttttttttaatgaaggcagtggggaggtatggaattattttaagccagggcatattataacacatttaccttttaataaaataatagcatacatttattgaatgcttgctatgtaccagccctatttgaattcctttatgtgtataaactttggtatacttttttaaatcttcacaatactttgtg

SEQ ID NO: 5002 - DNA, 33103 bp, Homo sapiens
ggaggaagcctacaagagaggtctggtgggcattgagttcaaagagaagctcctgtctgagaacgagctgtcactgggtataatgatcctgaaacaggaaacatcatctctttgttccagccatgaataaggaactcatcgaaaagggccacggtattcgcttattagaagcacagacgcaaccggggggatcattgacccaaaggagagccatcgtttaccagttgacatagcattaagaggggctatttcaatgaggaactcagtgagattctctcagatccaagtgatgatacaaaggattttttgaccccaacactgaagaaaatcttacctatctgcaactaaaagaaaatgcattaaggatgaggaaacagggctctgtcttctgcctctgaaagaaaagaagaaacggtgcagacatcacaaaagaataccctcaggaagcgtagagtggtcatagttgacccagaaccaataaagaaatgtctgttcaggaggcctacaagaagggcctaattgattatgaaacttcaaagaactgtgtgagcaggaatgtgaatgggaagaaataaccatcacgggatcagtggctccaccagggtggtcctggtagatagaaagacaggcagtcagtatgatattcaagtgctattgacaagggccttgttgacaggaagttctttgatcagtaccgatccggcagcccagcctcactcaatttgctgacatgatctccttgaaaaatggtgtcggcaccagcagcacatgggcagtggtgtcagcgatgatgtttttagcagctcccgacatgaatcagtaagtagatttccaccatatccagcgtcaggaatttaaccataaggagcagctctttttcagacacctggaagaatcgagccccattgcagccatctttgacacagaaaacctggagaaaatctcattacagaaggtatagagcggggcatcgttgacagcatcacgggtcagaggcttctggggctcaggcctgcacaggtggcatcatccacccaaccacgggccagaagctgtcacttcggacgcagtctcccagggtgtgattgaccaagacatggccaccaggctgaagcctgctcgaaagccttcataggcttcgagggtgtgaagggaaagaagaagatgtcagcagcagaggagtgaaagaaaaatggctcccgtatgaggctggccagcgcttcctggagttccagtacccacgggaggtcttgttgacccggaagtgcatgggaggataagcaccgaagaagccatccgaaggggttcatagatggccgcgccgcacagaggctgcaagacaccagcagctatgccaaatcctgacctgccccaaaaccaaattaaaaatatcctataaggatgccataaatcgctcatggtagaagatatcactgggctgcgccttctggaagccgcctccgtgtcgtccaaggcttacccagcccttacaacatgtcttcggctccgggctcccgctccggctcccgctcggatctcgctccggatctcgctccgggtcccgcagtgggtcccggagaggaagctttgacgcacagggaattcttcctactcttattcctactcatttagcagtagttctattgggcactgtagtcagttgggagtggttgctataccttgacttcatttatatgaatttccactttataaataatagaaaagaaaatcccggtgcttgcagtagagtgataggacattctatgcttaagaaaatatagccatgattgaaatcaaatagtaaaggctgttctggctttttatcttctagctcatcttaaataagcagtacacttggatgcagtgcgtctgaagtgctaatcagttgaacaatagcacaaatcgaacttaggatttgtttcttctcttctgtgtttcgatttttgacaattctttaattttggaagcctataatacagttttctattcttggagataaaaattaatggatcactgatattttagtcattctgcttctcatctaaatatttccatattctgtattggagaaaattaccctcccagcaccagcccccctctcaaacccccaacccaaaaccaagcttttggaatgagtctcctttagtttcagagtgtggattgtataacccatatactcttcgtgtacttgtttggtttggtattaatttgactgtgcatgacagcggcaatcttttctttgtcaaagttttctgtttattttgcttgtcatattcgatgtactttaaggtgtctttatgagtttgctattctggcaataaacttttagacttttgaagtgtttgtgttttaatttaatagtttataagcatgtataaacatttagcatatttttatcataggtctaaaaatatttgttactaaatacctgtgaagaaataccattaaaaaactatttggttctgaattcttactagaggtggtcttttgaagttagtcctttcggtacttctcagatgcctgtcatgtacccgatgagtccttggaaagaaggcctgtgtaaagaggccagcctggaggtcaataacctgttctatttattctggacattgagtaccaagtagcattggcaaaagtcatcatcatagcattgaaaaacatgaagttgctaagatgctttttgggtatcctcaaaatagatagtgtttcacttttcctgtaagaggaaagaattgtcctggaacccatgaaaatgatttctgaagagttcttgctctctgttgaaggacaaggaagtataagcctattcctttggatcaaagagaaactactaaattcacacatttgtcattagattaacatgacttcactgaatacccaccatgtctagtttgggttaggtactatgaagactgagtagaatttacaagcccccgacaacaaagcattgcaatatgggtggggacagaaacagataaagcaatcagtgggacaactttcaaatgtcagagtatatattaatacaaattttatagtacagatagaaaataggaaaacatgctaattgttagaacaaaaatcaagattagattaattattgggggcttttggtacttagggtgaaagtacctccattctcattgcatgggctatttttcctccacagcactcttttcttccttatttacctcttcttccttactccctctcctaatttggaggagttgaaattaattttatgcattaatactgagttcgcgtgccatgcattgtgccagaagccatggagtctgtgctagaaataatggtgaaaaagagccctcataatccaaaaggaagaagaaaatgtggtaaatgctgtatgggaaaaatgaaggaaattccttatgctagagctgggagactatattagtcacctcacctgccataacaagatgccacagactgtgagcggcttaaacggaagtgtattttctcacagtctggaagctaaaagtacaagctcaagatgcaggcagggctggtttctagtgaaacctgctcatgggtggctatcagtcttatctgattagagtacccacccctcctttatgacctcattaactttaattacctcttagggctctatctccttatacagtcacattgtgggttggtattcaacataggcatttttgagggactcaatccaatccataacagaggcctagcctagaaaggagtctggagaccactccaggaaagtgatatcaaaacagatcagcagcatcagtgtaagcagttcctcgggctgaaacagtaactagagagtacagtcaattgacaaatctttcctctccctccaggcttgtgccaatgttgtcatgaagctctgagatgacatggggctgtatctgaagagaggatatgtttgacgtgggctaagttttaatttggttcacatatacaaacaggaaatatacactagaactttttatcaggagtcatgtcacatcagaaatagtctcacattttccagaccaaccagctaactatggaaatgcaaataaaaagtaaggataccgggctggggcggtggctcacgtctgtaatcccagcactttgggaggctgaggcgagcagatcacaagtcaggagttcgagaccagcctggccaatatggtgaaaccccatctctattaaaaatagaaaattagcagggtgtggtggcatgtgcctgtagtcccagctactcgggaggctgtggcaaagaattgcttgaacccgggagatggaggttgcagtgagctgagattgcgccactgcacccagcctgggcggcagagccagactccgtctcaaaaaaaaaaaaaaaaaagatactgtagcagagtatgaatacattaacttcatactcctctcttaccagcttctagccacttctgtttttatggtgctgcctatttatagtcttatgactatttttttaagtgagaaccgtgctattgcctttagaaataattgttcaccaaaaaattcccccacagttccttcacatgggtaacaaagtgcaaaaggaaaccaaggtttgacacttgggcttgaaaaaattttaaaaagtaaataaaatgggttagattctaggagttgaaaccatttggggaaactacaagggctaattcaggtgttgggtaggaaatgtacaaagttaagcttgtgttatcaaagcaagaaagcattcaggaccaatagggatacatgaaagacacagatggcttaatgtggcttccactggccacattgggacaatttgagcatcaacaagaattatgatgttaaaggagtatattatattgaataaaaaaaaaccttaaatcaataactttaaaaacaccttgattcccatagtgaagcaaacctaaaatggaggtgtggaaagaatgccagttaataaacataaaaggcatgatactattgggaatcacttataactcctaatgtaacaacagattcagtgaaggactgtatcaaggagtggggaacaggttattcttatggactcaaggtataatccacagattgcttaccaattcctagaggaaaatgtactattagaatgaagagatgtagccaccacctttaccaagtgatcaatttagcattactaatataactgagttatgcgtccccgtgagttggcaacatctcttaggagtattgcaaaagtgctcaaactgaatctaatcatgagggaaacaaaatctgacaaatcagaatgagagagattctacaagacaactggcctaggctcatcacaacatgtaatgatttataatttaaaaaggagggtgaaggaggctgatctggattaaaagagacaataactaatttagcttatgagttgaaaaaataaaactgctatagaaataattttggggacaatggggaatttgaatatgaactgtataataaatgattttatggacttactaattttcttaggtttgacatgtattgcggttacacaggaaaatgttcttattcttagaacatgcatgctaacatattgggggtgaaaaatctgcaacttactttcaaagaattcagcaaaaatcattgggtggggtgtgaatgtggagagaagagacggagagaaatcaaacctggcaaaatgttaacaatgagtgaaggacggctaaacgaaagctcattgtactatttttaaaacttttctgtagctataaccgttttttctgaggaagtcgaggagggcgaatatctttctggaaaggccagagcaaatcacgcaagagctgagaaaagattggaaaacgcctctcaaaataacagtcccgcccttccgggactcttccctataggctgttcaagtcacgtggcgactgtggccccgcccacagctccagaggcctgcgcgtgcggtctgcagttcggccgcttcctcttggcgggtgggctgcagtatggagggcgagcctccacctgtggaggagcggcggcggctgcaggaggagctgaacggttcgtggagagcggctgccggacgttggaggaggtgaccgcgtccctgggctgggaccagatagtctggatcccggggaagaggaggcggcggaggtgaggagcgcggccgcggggcctttcggggactatcggcccggggtcttctctggaagaagggagatccgcactggcagcgcggagggaagggcgaggagtcctcgtccgtgtgcagagccgcgatgggcgcctgggaccgaggggcgccgggggccctggagcaaccctgacgtccctgggttccgggctggggcgccgaggaactcccgaaggctccacatcgacctccagtgcggcgctcctcccgcgcaacttgagtttaaagaaaaccgggggccgggcgcggtggcgcacgcctgtaatcctagcactttagaggccaaggcgggaggatcccttgagcccaggagttccagactagcctgggcaacatgtgaaacctcttctctaccaaaagtacaaaaattagccgggtgtggtggtgtgagcctgggccccagctatttgggaggctggggtggaaggatagcttgagcccaggaggtcgaggcgcagtgagccgagatcgctccactgcattccagcctgggcgacagagcaagaccctgtccaaaaaacaaacaaacaaaatccaggaaggtgtgttgagtgaggagggaatggcagattggtatttatttagaaaataagtgaacgtgtctcagagcgctgcagagggattggcggttgcattgtcatctgtcatacggattccgcagttgcaccagattcggtgtcaggagagctggagtttgccagttcgcctttctgtgccttaaaattggacacttctgactgggacagcacaattctaggattattaaaggttgtcaccaagaggtggtaactggcaactcctgtggacatagaattgcttttttaaaaatgtaggcaagtgtatttagagtgaacattcgtgattttttttttttgtggggtattttcggtggaatgagaggaagggaagtgctccaatgtggggtattcattatctttactattacttctgggtttaccatgctgtgataatttctcctgggtttagttacatgactgattcctcagaggcatttaaaatatatttgatttctgtatataccatcattgtttattgtattaaaagcacagaggaaattaaaaaatctttaatattcatttagagggtatttgaagctgggaattccactgagtggggcttaccagacccttccatacattgttactcagcattgcggtaacattggattccttgtattaacgtttaaatagcactttgtttccacttacattacttcatttaatactcaaaataaccctatgaggtaggtatctttggcccattttatagacgaggaaaggaacacagaagtgataatttgtcgaaggatacactgctataaatggcagttaggatttccgccggtgttttagtactgaaatttagtgaacaacagtctagttgtcatctgttcctagttgtcacctagttcctagtcctcacagagctagtcctagtgtcacctagttcctagtcctagttgtcacctagttcctagtcctcacagagcttattgctggtggtgatgaggggtaatacggataactgaaccattatattatcatgggtctgtgagggtggggttggaattgctatagtacagtttattgtaggcggtggtggacaaagtggtgtcagcaaaggcttcctggacaaagtgaattctaagctgataaataaaagtgagttgaatggctagggggttggcgggtgcggggaagaagcatcaacagcatgtgtagaagttcagagcagggagtgaccagatcgggaagcctcaagtagttaaggatagctagagcatagagtgtgagttagagtagaatggtgatggtgggtagaggtcagatcttaaaggtccttgtcagcctattagaaagtctagatttttttttttttttttaatgaaggcagtggggaggtatggaatattttaagccagggcatattataatcacatttaccttttaataaaataatagcatacattattgaatgcttgctatgtaccaggccctatttgaattcctttatgtgtataaactttgtatacttttttaaatcttcacaatcactttgtgagagaggtcctgctattatttttatttatataatagaaaatgaggcaaagagagattaagtacctcacccagtttcatgcagccgtaagtggcagagatggaattcaaaccagctacaggatggaaactgaaggggagggcagaagactggaagcagagagagagagcaagagtgagagagagcgagcgagcgtagtcaggaatggtgttgtattccaggagagagttgatgataccctgagttggggaagtggcagtgggatggaggatgttgagggattttcagaaatatttaggagttaaattggcaggactaggtgttgattggatgtgggtgatgagggagaagtagtttcttgcttgagcaagggggacctttactgaaatagaaaagtacaaaaggaatagatttgagggttgggagatgatgaatataataatttatttttgtttgtgttgaacttttagtgtctttaatatacggtactggagagaaaaaggtttaaagatctaaattttgggagtcctcactgtatagtgagagttgtagctttgaatctttcagtaagcatatattaaacagcaaaaggtcagtggttatattaatacttacataaaaccaacatctaaagggggacaaatagagcaaggaagacagatatttaggatatttaaggagaccaagtagaagaagccagagaggtagaaagaacatgaggggtgtgtcagaatccagatggacaattggagtgtgaccttccaagagttcagataaaacaagacagtgacatgttttggctttagtaacaaggttattagtgacctattgactggtttcagtggggtgatggggcaatgagtgaggaatcgttataggtgaggtgaggttgtttagacagtgagtgtaaatcacctttcaaagagttaggctttgaaggagtggagagaggacaggggcatttagggagtaggggttgaaggagttttatttttctttaatacacaactacatgggggttgagagaggctgtagaagaggatgcactatacagtactggtacataattaaatggtaaacatttaatggaattatttatttaaatattatgtacctattttctttgtttctgtttgatttttataggagaagttgtgatatgtccatacgattccaatcatcacatgcctaaatcatctttggcaaacacatggcatcttgtagattgaggaaaatgggctataccaaagaagaagaggtaccataatttactatattatatatacatatatgtcatgcattttacacattaattcacaatttttgaagttacaatgtgaggttcactgacaaaataatagcccttacttgaagggttggttggacttgcctaattgcacaaattattgtgagaaataattaagtgatactaatctattgtttggtcaagtcttaaaatagtcaattatctgatacttaagaacagtaagattcttttttttaggatgaaatgtataatcctgagtttttctatgaaaatgtgaagataccttcgattacttgagtaagtattaagttattataatttaaaaatatcttagtgtagatattgatttttcattttgcattatgaaaagaatggattgtataagcatgcttatgacaaggacatttagtacttaagagaatgtagaattaattaatgtacaaggcaactaattcacataatctgaagtttgagaccaggcttgtattaataggcagtgaaaaccttacaaagctttgtatagtagagcaacaccttctttctcagttacaacaaaaatttgagcatgtgacacagattgaaggatgagctgaagatggacatgtgttccagggattgacagcatatatagaggttaaagtcttgggcctggaaaaagaatgtcctgattcaactcctgtttttatcatgaaagatgtgactttcaggaggtaattaacctgtttgttgcctaaatttctttataaaatggagatggttataatagactttgcgaagattaagtgatatatatatataatattcttagaatagtgtcaggcacttgctggagtcagctagagggtcacagagttgtgaccattacagcacaggcttcaagaatgtagctattattggtcagtaaaatttgtcgctgctactgctgcgtgcctaattataggcagaactgcttgaagtctgattacttactgggctgtagataaatctgaaaggattctgtgtcagatttcatagacagggatgtggatgtttcttaagattctggaaggtttgtccacgtgccaaagggcttggatcagaaaccagttaataatttaattgtggtcactgatgattcatatgtatttatggatttttttttttttgacagataaggactcacaattccagataattaaaaagctagaactgcagttgggaaagacagtgattgttataatcaaagtaagtggcattacgtttaagtgaattaaagaatgaaattattatttttctcataagcatgttactaattttctcaagaaaaacctgtgaaaactgttacatgggaaaggtaaagttttacatttaacattggctaatttgcttcgtttcaacttcatttgttagatatttcctgttgagatacaccagagctcactaagacactatcttagctaggggttcatcctttggaattacctggcgatttatagtgagattgtcttgtggctaattaaaaaaattattatttagtaaatacagatggtcccacttaatgatgatttaatttaggattttttcaattttatggtgttgtgaaaacaatacacatcacaaggttttagactttaagtactagtgattcttttatcagacgctgggctgcatttcaacttaacggtattttcagtttatgatgggtttatcgggatgtaaccccatgtaagtaaggaacatctataaatgccactgagtgaggctcttttactcttgagatttcctctcttagagtgttgaaatgcagtgtaaagaaaaggcttaggctaaaagagattagtctccacagtaccctcagattgcttgctacccagtaagtgagttggtttgaggtgatgaatgcttgggtccccttctcagaaaaaaagtacaaacacaaaagttttacatataatttcagaggattctattaatagatcctttcatgcccagctttagagctgggttaaagagtttctccctgggacctcagcagagagtaggttagaagttttaagcataagcttttaggaaattgaaagaaaattcatccatcaaaaacatagacataggccagacacggtggctcatgcctgtcatcccagactttgggaggccgaggcaggtggatcatctgaggtcagaagttcaagaccaccctggcaacatggcgaaaccctgtctttactaaaaaatgcaaaaattagccgggcatggtggcaacacctgtaatcccagctactcaggagaccgaggcaggaagaattgcttgaacccaggagcggaggtttcattgagccaagattgcaccattgcactccagcctgggcaacagagcgagctccatctcaaaaaaaaaaacacacatagacaaacgagttaataaaagtttaaatttctatgaatgtagatatgacatctagccaaaacctgaacagcttctcttgtaaggatttctgattgtcttctttgaaccttctgtaggtagctttctctggacaacttacctttttttcctattcttttttctagctgaattatatttaccaggctgtagtcatggttggttttctccctattgaaattgaggatctttaccaaatactgttctaagccagtatctggacttgatttctagagttgcgctatggcttcagaagaaagaccatcttatccttagttgtctatattacatggttctctacaacagccagaagcacatttcttgtattttttgttttgaggttcccactttgtccctgtcagggaaattccaggtttttttctttgagggagacagttgactctcatttatttattcggagagattactgagctatgactagtcaagccttttttggcctctgctattgttctgctcatatcccctggtagtgtacccataaaaaagttgaggtttttggtttttgaagggttaataatacttaaaggactttatttgagtcttaagtggttagatttactgaatttagagttgaaagagaacttggagatcatctaatccagtgtctgcattttacagataagaaaaccctgtctgatagagacatgataaagttctagtgtgtttgttctaaaggttctccgatttttattttttaaaaggttatttttttaaagctcttttatgaattacatttctctttacaacaaacttgtgataagttgaacgatattttcccctccataataggtgaagaaacagcacacaaaagtgaagtaactcacctctgctagataatatcaaagtggatccagaactaattctgaattttgacacaaactctgaactgagttgtttgattttctgttagaaaccctactttagtaaaatttgtggaccaggattctagatattgctcaaatttatttatgatgtcttcatgattaagtggaagaatatcacaaacttcatatctctgcatactaatcgtgactatcgtgctgttcattgtttattctgctttgtgtaaacctgttttaaagaaataaaagtagctcttggccatatattaatgatgataactgagtttttgtttccttatctgtaatacaaaacctcatagagttgttgagaggaacagagataatggatgctaaacaagccttagctccaaaattggtagcttctatggtctaagtgaaaattaatatacagaaagtaatattaagataataaatggatgagttttatatatatgagtaatttagaaaatgttctgctttttaatttttaaatagtaataagggagatttggacattgagcttagttcttttcaaaagcaaagaattacttgaatgaatagttaagaggaactattatattattttgatagttaagaggaactttaatttgaattcttacactatcttaaattaagatttaattgttaaccgtaacctttttttttttttttttgaggcggaatcttgctctctcgcccaggctggagtttagtggcacaatctctctcactgcaagctctgccacctgggttcacgccattcttctgcctcaggtcccgagtagtgggactacaggcacctgccaccacgcctggctaattttcttgtatttttttagtagagcggggtttcactgtgttagccacgatggtctcgatctcctgaccttgtgatctgcccacttggcctcccaaagtgctgggattacaggcgggagccaccgcgcctggccaacggtaacttatatgatcttcaaccttctttaaaaattttttttggccacgtgtggtggctcccactgtaatcccagcactttgggaggcccaggtgggcagatcacctgaggccaggagttcaagccagcctggccaacatggtgaaaccctgtctctactaaaaatacaaaaattagccaggcctatggtgcgtgcctgtaatcccagctactcaggaggctgaggcaggagaatcacttgacctgggagatggaggttgcagtgagccaagatggcgccactgcactccagtctggacgaagggtgagactctgtctcaaaaaaagaaaaaaaaatttttttttatatcctctgtagagtatgcaatttctcaacagattatttttgtggctcacttatgtcttagacattttaagatttttccctcaggacaggactttctttaaatatcttattgatgtatttacttttaagggaaatgactaacatgaaaaattttacatttctccatctaattcgtattttgtttgttacacctacaatgtaagttttttgacaaggttttatatgtatgttttcatttcatctgtcatgtaggcctaaactcagtgtacagaattctcaatcttaaactttatgaaagctcatacagctttcaatctatatacttattttcagatatagttacttcggttaattttttaaccaagatattcaatcataaacaatcattttatgtttagtggtttatctttttctttcaatattaaatttcaggttgtatacttcagtattgtgaagtgtgtttgagtcatggccatgatatgaagacagtgtactatcaaagaaacttaaaaagacagcataggatgggctttagatccagtctgtcctatcacttgtgagactttgggcaagtcatgttacttctatgacacttaatttcttttctgtaacgttaaggaattgactctgaatgaattctccctaaaattctgaatttgtatcttgtgacaacacctactagtactatttaatgttgaatgttatatgtttaagatccccttgatgacaaaagtaacaagaatgagaattggcattattaaaacaatagattagagtttcatttggggtgacgaaaaagttctagagatggatagaggttgcacaacgtgaatgcacttctgtctctgaacagtacactgaaaaaatggttagaatgttaaattttatgttatatatatttgccacaaaaaacctgcaaaaacaggcagccaaagggtcttagagttattataattacgcacattcatatgtacctttaaatcatttaaaaacatgcattttgaaaatttacatttttgtaaatgtaagtttatttaagtatgtttatcctttttgttgtcagaaatatctatgttcgaatgaattgaatgcagtttgttgcttaacctttcctgtactttttctttttcagtaatggggtgagtataaagaggaattaggaacctgaatgtactccttatttaaagatatgcatatcctttttgcaaatgatatccttttaaaagtaaaatttctaaactttatcttaatactgtcacatattatagtcttgaattggaattttggttgaattacaaggaatttaagtatcgtcttcatcataaagaaatttaagatgaataaattgaagaaaaggctaaaataatttaaaaggaaattatatttctttgtttaaaaataacaggcaaaggtttatatgaagcttgttttaatacatcattattttctaatctgtgttttcctcccaaatttttatagcctaattcaaggaattaggcttatcaaagctgtttttataattttgtattatgaaatgcctactataatagaataaaattgattgacttgaaagggaacccttttttccccattaattcaaaacccttgacgagtaaaaatggccatatattgttatgtatagccgtgttaaaccatggcctcagatcactgcagctctcctcttaatatgtagacaagtagtacctcttttttgttgtaatgcttgttcatagtatgctcttatttgaattctttttgcctctacctaggaacttaatgaggttgactttatcaaatataagtatctggaaagagctactgattttatgttgttctatgaaccgttactactttagaataagttagcaaacaataaaaggattcctttagtagctcatgttcttgtttgcattagtgagtaatgaagtctagaaagaattgttttaaattgctttttttacgttccaatcatttttttatttgagaaaatttgaatctcaaaacaaaaattttcttcaattttaatacatcatatcaaggtattgtatttactttttttcactaatgagcagattttagaaattctgtaactaccggggggcactgctattaacttttttcaattaatttggttaagcactatgcttcctcctcaggaaattaaaatgagtttaatttaatctgtgctttcctggcggaggaggtgtgggatttctgctacttaattattttgtggcccctagctctaagtccttgacaagtgggatatattttgaatattgaccatctagcttgatgtctcatacaaaaagatatttttacacagtttttaatatttccatagtttattttcaaagggactgtaatgcatattcttattaaaagcattttttcccccaactttgatggggaaaagcatatcaacagatacctcttttgtagatggctataaaaattgttacccaaaaggctttcttagagcaaattgtctctatgattattcctgcctgcctccatgggatctgtctttatattgttggagagaatagcaacatccataatacatttttttttttttgtggatataacattcaggatagaattgtttgtatttattgcttagattgatattttgtatacttagggattatgaaaaaagtttgtgttaaattgcattattaaagcacatgtttaaagataattattagattttaagttcacaatgcttatgtattgtttattcttgtgattttatttttactttaggaatttattcttcattgcctgtgaagttcctttgaatcacaaacggtttgtttgtgatctaactcaagctgatcgtcttgcctctatgatttcgtagttgaggagacaaagaaaaagcgctctgattctcaaattattgaaatgacagcgatctctttgtagacttggctgccaaaatcaatcaaggtttgagatgcaatcatggctttacatttcttcattatcattttattctatgagtgttattaagatgatttattcttgggccactttgagttagagtaaaatggttttgtatcatttaatattgacatgagttggccctctgtgtctgtgggttccatatccatcaatttgaccaacggtggattgaaatatttggaaaaaataaaagtgtgtggttgcctctgtactatacatgtagagactttttatcttgtcataattccataaacaatatattaacaactattcatgcagcatttacatcgtacaggtttttggtgttttttttgttttgtttttttgagactgagtcttactctgtcacccggctggaatgcagtagcgcgatctcagttcgttgcaatctctgcctcccaagctgaagcattctcgtgcctcagcctcctgagtagctgggattacagacatgtgccaccacacctggtactttttgtatttttagtagagatggggttttgctacgctggccaggctggtcccaaatcctggcctcaagtgatcctcctgtcttggcctcccaaagtgctgggattacaacgtgaccactgtacccggcctgtattaggtattgaaagtaatttagagatgacttcaagtgtacggagggtgtgtgtaggttatatacaaatactacaccattttatatcagagacttgagcaccatggattttgatatccttgggggttcctgaacaaattctgcatggatactgagggattttactcagtacctgaggttttactctgacttttacattaaatgtaccttctttctgtgaaatattacaactgtgctgttactttaatctatgtacctaagcactcttatgttcaactatggctggagagaagaaatgatataaaacttagcccgtgtatataaataatatacaattttagaatgtttttatgtgctactttgaaacaagttaaaatataggattgtgatgtattttttgataattcatagaatttaaaagctttgaaggatataatacttttattttattctttattagacaatagtcgaaaaagtccaaaatcctaccttgaaatcctggcagaagtacgagttataaaagaagacgccagtcctatagagccaagaatgttcacataaccaagaaatcattactgaggtaagttttacataatctttgttgataagaatttcccttaggtaattttctaatctgttctatgaatttccacaattctttggaaattttctgaaagtgtcttcagggtggcacacctgatttgtatctgttccatcacttctagatccaccctttagcaagcaaaggcttcatagtataagaaccttatataaaacaattgtacaatcttaaaagatatctccttgtggaaagtagtagtgtatcatggtaagagcatgagtttgggtttaggtagaccataccttgcttttgattctgctgtttctcattggctctttgacttaagcaagttatttgagctttttgattgaatgttttcttttcataataataataatataatctttgcagggttgttatgagattgactgacagaatgtatgcaaacacaaatttcttcatgaatattagctattatctttttggcagaaagcatgtttttatgtactctagtaaatatttggacttaagaaatgtcttgaatacattatttatgtattagtctcttggtgtatgtctagacttattttcagatgccattaatggctcgttagagttgatgaatttttttggtatgtgaattaccttgcccagactctaaaataattgcctcattgattccctaattgttcccgtattatttcttacttctctctgattaaaagaccttccataatctggcctccttttcccaagcatttcttttgctttagtcaagatgtctcttaaactatatctgattgcatataattattcttacctccatgccctattaccgttactttcttacctgaaatgctctgtttttgccattttaaatcttgttgagtttaaggccaccatttccatgaggtgctagttgactaatctatcactagtttattgtactaatacttgtaccacacagcttagctctaaattttatgctgttctttttacagttaaaatctgtgtttagacttaacttagcaagtagagacctgggtccctgtcatactaccttggtgattctctagtccctaagatacttggctcatcagttatttcttctctcgtctcataacccttgtaacaagcttaaatgttgctgctagcattctttacggttttatagttgatattttattgtggaatattcaaacatatactaaagtggatagcatcgtctaaggaatgtacccatcacccagttcaaaaattgaaataaaagattggcaagggcttcatagagaaaagcatttgagggaaaggagaagcaaggaggaataaaggaatgtctgctattgactcttgcctatgtggtggagctgagctaggtggattctgtgcaaatagcaggcttcaaggcgcttacatagagctgctgaagggaggcttgtaggcctgccagggaagtgcgagagctggaacttgagataggtgtgtggactcatgtcactccgctaggttggaccttggcatatcttaggttttccatgggagaattagtggaggaggagaagtggtggataaggattttccgggtggaagaactagcattctgaaagcagatagaagtataggagtttttcagagactcattagtaacccagggtggctagagttagggcttctctgttgagagatgaggctaagttctatcttatgtaggaaaatcctggaggctctgaaggcttcattaaggagtttggatattgttcgattttactttgagagccattaaagtttctttaaggtggggagaaatgcagtcaggcctgaatgaatagtgtttctgagatgccccgtgtcccctataccttttttctgaaaacattttctatttaatcatgagggaaggtaaactcctattttagttttgtctttgcctctgcagtgactaaccctgtgcttggtggatgggtaaataggaaaggaaaaactttcaagtggtttttacctatttgaaagtttcttttagagtcattcagaaagtatctgtgaagtgactgtatgtttcatattttgtcttattaatcatatgattaagtcaagatgacttaattataaggttttaaaaaaatcatttgtaaatagctctaatagagagataaattgcaaaactaaaaatagtaccaagaactcccatattgtcttacccagatcacccattgttagcattttgccacatagcttctcattggcactctctcttctctctctgcacatttttcactctctcgatctcgatctgtacatatttttttcccctgattctttaagggttaaattacatacctcataaccctttatccccagtatgtatttcctagaacagagatattttctcacataaaggtagtacagttatagcaacttcaaatttaatatgctgtaaaacttttatctactattcatattccagtttgaccattgccttttctgtgttcctaaactgcacaagtcccacagtcaattatgtcatagcacttagtaaatatttgattgtagcactgatttttctagcgttacagtcttaattttttgagcagttttcttacctgaagtcggtgcttacctctcccaaggtgattcgagatgtgataaatgtgcacatggaagaactcgcaatcattggcaagaagagcaagagaaggcagaggatgatgccgaaaagtacgtcatttctttattggtgaaaatactctctctttgataacagataacaattaacttataattgttaattttagcatttccaaaacccttgatagcacacagtaaactcgtgaaaatgctttttgttttcgttgtcagtgcccagggttattgtaccagagttgttctgacattaccctttgacgttttcaggggatagccatattagtgaaatattcaaatagcaaaacatactaacatttagcctagtattccattatgggaacaccaagcatgtgggagttatttatgtcctactgctcaggtcatcgccaaggtctcattgcaaaaattaaaaaaattgcaacctcaggcataaatggttaagagctgtgtttatttgtccttttatatgggttataagattgtgcatatttagacatatctaccattggtttgatatagaatattacactttagactggtgtgtctgtgtacgttactggagaccagtggtaacacaaactgattaacattcttttctatgttttaggaatgagaaaggcgatcagcttcagtagattcacggcagtctggtggaagctatttggatgctgatgttcacgacatagaagggataggagtagaagcccacataaaagaaaaagaaacaaagaaaggataaaaactgtgagtcgagaagaaggaaagagaggtgggtctaaccctgcatcatcaacgttgaattctgtactttttaaaaatagaacaggttcttctgttgtagaccatgctagaaaatagattttaagaataagctaaagtaaggagagtaaacaattgacgatgattctaacattcattatagttcagttcaaataaccaccactctagtgacatagatctctacatggtgattggatgtttttttcccttttttatctcttacttgcttgcttcctaaacaggacaatgaaagtattgtctaggcaggacattaactgttaaacacggttttcccagatccctttttctgctcattccttccttcctctttctcttattctttctttctttttcctgctaattctcaaataagggtatgtagggtcagagagaacatctaaattttgacagtcaattttgccttgttagtaaaattttgatagcttgagagatgtgaattaataccgaattagtaaatgtaatcatttgaggtctatttctgtagtccagctgcttacaaggcatgtacctggatctcaagtcatcaggtctagaactaaacttacctttttctcaatctgctcctctttccccagcattctgtcctggttaaagagatgactctcatctattaacctaagccagaaatcaaggagtcatttagatacttccttccactccttatcatctggtcagttcctaatgaaatgatggtcatttcctaatttttctacttgtctctaaatttactgcatatgattccattcccttgtatacgctagagtgaatagtcacctcatagaactcttccgtggcggtctggcatggtggctcatcctataatccctacactgtgggaggctgaggcaggtgatcacttgagctcaggagctcaggccagcccgggcaacctggcaaaacctcgtctctacaaagaatacaaagattagccggtgtggtggtgcatacctgtggtcctagccacttgtggggctgaagcaggaagattgcttagcctgagaggttgaggctgcagtgagccgtgttctcacccctgcactccagcctgggcacaaagtgagaccctgtctcaaaaaaagtgagaactcttcagtggcaaaattcacattcttgaatggctctcaagacttctgggatcctggctcctacctacttcttgtattttgctatacgccatgaaatgcataacttgtcctctagccagcctgagttacttagagttcctcatcacactgtgccacatctatgcctttccacttttgtgttctgctgcctacctctttttaaagcctacttggtaaactcctcctcatcctttaagacccatctcagccatttcctgaagctttttctcacttgttcaagcagagctgatcatcttttccattttgttgccaccctacctgcttatagttgttcttgagcttaatagttattattatcgctgctagactgtgagctccagaaggcaaggtctgtatcttacttagttttatacacaaagtactttcaaatattaggcttcaaataatatcctgtctctccagggccactggtaatcaggaattaaagcttattgtatggtttggtaattttgttcatcttactatcattcagttaattaggtttaaagctacctatacttagtccttttcttatacaaatgaaatatttgcttagtaatcctttttgattcatatctgttttataataactatagtgcttcttctacttaagtaatttttgacatctctaatcatccctgttgacttaaatacattagaagtcctcaaaatctaaacattaaatagtttttattaaagaagataaactggatataagtaagaaatacttctcaacaggctaatctttgatatcaaccctggggtggactgaattatagggactttgtttatctgacgtaaaccagaacaagaaaacattcatttcgaattaaagtgtttttttttttaagagtatgtatgaaaaatgcatattaaaactaagagacaggccgggcgtggtggctcatgcctgtaatcccagcactttggaggccaaggcgggtggatcacctgaggtcaggagttcgagaccagcctggtcaacatgggaaaccctgtctctactaaaaatacaaaaaatagccaggtgtggtggttcgcgcctgaatccagctgcttgggaggctgaggcaggaatcgcttgaatccgggaggcgaaggttgcaggagccgagatcgtgccatttgcgctccagcctgggcaacaagagtgaaactccatctcaaaaaacagaaacaaacaaataaaaaaactaagagacgaaactgaaataggaataatcaagtgattttttttaaattacgctttgaaattctgctttaaaattaactttgagtatatgtaatgataaccagaaaattcttttcaaatagaatgttaaagtagcatattactgttgaaatggtgtattactgttgaattattttaaagctctgatattaaaatgtccatcatttataacatttttttatacctcttttatttcagggatggggaaagacaccatagtcataaaagaaaaagcaaaaaatataaatgaagtacttgtacctatattaattatgcttacgccatgataccaatatacagatatattaattggaattcctttgcataggagaatgtttttatgatctgttagtgcttattattttttttatgatctgtttagtgcttattattttccagtaaatatgttcaaaccatgagtacactattaggccctacaactttgttttccttatattttattagagatttgcttcctataactgatgttgttttgttcgttttgctaatatatgtatctcaaaatctttaagtcaatatttatcatatgtaaattaaacatgaatacattctcatcttataacacatcttataaataaggctaataacccttagaacaccacctgcggttctgtcctcacccagtggcgactactgtttaccactacactggtgaattgtagtagggaaaaacaatctaaaattgaagaggaatggcctaattaaaatatgatgtagtcataggatagattattgtattgagttaaaagaaataatctagatccatattaacctggattggtctcaaaaacataatgctagtgaaaatagcaagttgtagaaagttatatacaaattatatatatgtacaaaacaatatatgcattctctatggctatataatgtacgtaaatctatttttaaaggttcagaggaatcataccaaagttctaacagcgagtaggaggtatagatgagagattaggggtgcaaatcagattgggagggtggtcagagggaactttagctttatccataacattaatttttttaaaaataaggtcttaatgtttcatttaatttaaaatatactgtcatgttgtgttttgtaaatcactgaattgaggtactatttacttagatttattgcaccctttttacgtgtgtattttatgggttttgacagattcatacctctgtgcagccactatcacgatcaagatacaaatatttcattgcccccaaaattctcataccccctttcccaatcaattcctctacccctagccctagcagccacagatttgcttttggttaccgattagatctatccattgtagaattcatgtaatagaatactgtagtatgtactttgccttcttcctctctgcagatttttgagattgatcctgtgtgtcagttgtgcattttttttgttgctgagtagtatgttctatcttatgtcagatattcacgtgagactttggcatgaaatgttaagcatccgacatctaaatagcaatattttaatactggaaactcaggttaaagattttgtttccaagtagaaatgaaatcttattatttaataagtagctgacagtgacagaaagattggatttggatcagattggctgttaggcttcggtatgggaaacagctctcagatttataaattggaaatcaccaggttacttgccaatattagtcatattgctgccattgtacttaatttctaaatatataaaatccacatttaaaaatataaaagcaaggacttgggagtgactgatgaatcatgaaattgctgcttttatagatcaaactacttgaatcatcaggaatttcatatttttcatattgtgtgacaacttataatttttttcaaattgtgatttcattgattttactaactggaaggaagaagagtaaaattggcattttaggttttttgtagaagaaagatacaagtgaaaattaggagtggattggagaaattgggggaaatagaagagtacggagaaaggaagagattgaaaatgttaccagagttctttaagctcacattttatagtatcactgctacaaactatttaatgaaatgtggcatcgggtgaaagaggcatttgtttgatccttgaacgaattaatctcacgtacttccctgtttgtggtttagcctttcactggatgtgagctacttgagagcagggtttatgccttcatcagcgtgaccctgtgcctgcagcctcataggtgttaatctgtaattttaaattttgacaaaagcattttacagccctgccacataagatctagtttttatttctagagtgctgctatgaataattacttagctgctgtccatcttgcccatccattaaggtaccttctcacaaacatttctaatctatggctggagtgcagtggtgcagtctgtagctcactgcagcctcaaactcctaggctcagcgatcctcttgccctggcctcccatgtagctgcaactataggtgtgtgccactacacctgctaatgtttttagttttttagagatggagtcttgctctgttgcctaggctggtcttgactcctgggctcagatgatcctcctgtcctcagcctcccaaaatgctgggagccaccaggaccaggtgtgatctaccacacctgtctaaaaagtatgtatttttaaatttttttgtagaacaggatctcactatgttctccagctggtctcaagctcctggcctcggcctcctaaagtctgggattacaagtgtgagccactgtgcctagtcactttaattgagatattggcaagtcactgccatgcagagcccagggcactggttatattcagtaggaaactgaactcagcactcgaattttaaattaaatcaatgatcttcaagtatttgccactttcgagtacagctaattgataatctcaaaccctttagtgaaaatatcttaaatgcattgagaatattttctaattactgtgtatgctacagtacagacattaattctataaacatgttcataggtcttccccctcgcccgcccgtcttctaagggcattttctgtttctttttagtgagttcatgaatgtttaacgttctggcgcaaagctttcttgcattctgagcataaaaataataaaacccacttatattgcttgagtgtgtttacaagtcaatttccttttatgtagcttgctttttcatttgctatattgatcctgcaggtgtgtgaattattaaactaacgctcttttaaaccacacttgttttatagtgattgtacttcctgctgtggtcacagatttaggagtttttggtgttacagaaagtctcatagcttttggatatttggactgggaccagtaatttctagagctccctttcaggaagaaaaaataagatttgccagatgtaaggggctctgagctagattcatctttattgaatagtcaagtcactttcccattttaaaaacaagtccacctaagaaaaaagaggctgccttaaatagaatataaattcctaacctagcttttagtcctttattttagtattataaagcagggtacttgctacatacagccatggggagaatggtgaatgaagaaaggctgcaggctccgggagtccttccttaggagtttcacatcttgtgtcaccaattaagggatctgggtttgagttcttgagtactctttatgaggataatttcccgtaattgtggagctttagtaacccatgttctccagctgcaagccatgactcctagtctagaatgagaaaggtaattaaagggagcgtcggaatacagagatgaagcaggagcctgggctttatttggtaatgccgacacaattaaaaaccaatactttaacgtaataaattcttcacatactgacagaataactgatcaaagagggagtaagatgagtcaggtacaatacaggctgtgtaaccctgggcagactcttagtccctcataccttctccatactgtatgccctcagaagattgtcaagcataatgtgatttggcccagcagtgtctgacatgtcgcaggtactgaatgcccactgttactgtgattcattacagattgagctcatcctttctactctggctcctgtgactggtttggattctcagatcggtgttcctctcattctgcatgctctgcccagcagctgtgacccactcttagttttaactatgccgcaaccaattccatgacttcagcccagacctctcctccaagcgccgtgtctatgcgtaaatagcacagcttctcctagtgctgtccacatacttctgactccacactgcaaaactacagtaccacccttccgtcaaacctctgcctcctcactctgtctttctgcatttggttcacgtaccatcttccttttcgatcatgctaaagaccagagagctggcgaggtgcagtggctcatgctgtaatcccagcactttcagaggccaaggctggaggatcacttgagcccaggagttcagaccaacttgggcaacatagcaagacaccatctctatgaaaaattagccaggtatggtgtacatgcctgtagtcccagcagctggggaggctgaggcaggaggatcacttgagcccaaaggttgaggctgcagtgagctgagattgcaccactgcactccagcctgggtgacagaggagaccctgtctcaaaaaaacaaaaaaacaaaaacaaaaacaaaaaggacctgagagtcttctcgatttccccatttccattaccactgtagattacctcctaagtatcttgtacaggtgagtatccttaatttgaaaatctgaaatctgaaatactccaaaatccaaaactttttggtgctgacatgctcttgagcctaagaggaaaattccacacctgacctcatgtgataggttcagtcaaaactttgtttcatgcacaatattatttgaaatattatatgaaattgccttcggctatgcatatacggtatgtatgaaacataagtgaatttcatgttagatttgggtctcttcccaagatatctcaatctgcatatgcagatatcccctaatttgaaaaatatccaaaactgaattggtctcaagcatttcggatacgggaaactcaacctgtactgagcccaccccgctttccatactactattttagtaagaaaaagccagcggactgttctctcttactatacttcaccacataacactttcgtgaccagatgtgcgtggattttccccactcgtcacttctcgggggacgccagctgggcatcctacaatttaactcatttctgacattgtctacctggagtatcatcagatcccacaagttaagggctcagtcccacaagactaatccccacttcagatcagtcagatgcaagtctgggcccctggtacttctgatgaactggctataaattgggggtcccacaatcccctttgcagtttgatcatttgctagctcagctcatagaacttgggagaaaaacactttacttgctattgccgatttattacaaagaatattttaaaggctacaaatgacagccagatgaagaaatacacaaggcaaggttgagaagggtcccgctcacaggaccctggtccccatggagttggagtgcaccaccccttctgaatgtagatgtgttcagcaacccaaaggaaactctgaacccagtctttttaagtttttatggaagcttcaataagtgagcatggccaggtgtggtggctcacgcctgtaatcccagcattttgggaggctgaggcgagtggatatctgaggtcaggagttcgagaccagcctggccaacatggtgaaatcccgtctctactaaaatacaaaaattagtcaggtgtggtggtgggcgccggtagtcccagctcctcgggaggtgaagcacgagaattgcttgaatccgggaggcggaggtttcagtgaaccaagattgctgtgccctccaggcttggcaacagagagagactctgtctcaaaaaaaaaaaaaagtaagcagatcgatgatatcattggccattggtgatcaactcaaccttcagcccccctcccctcctagagatggggcacagggagggctgaaggtcctaaccctgtcatcatgctgccagttccctggtaactagccctcatgctgaggccatccaggagcccccagccacccgtcagttcattgatacaaaaagacacctatcactggagattgcaaggagtttgggagctatggctcagaaatgggacaaaggccaaatatatgtttattataaatcacagtgtcttactaccctgcctattccagtggcaaacatctcttgcctacactactacaaccatctcctcattgcttttcctcctctttttgccctcaggccagccccacttacagttgcctaagtaattgtctgaattcccccccgagctcttccctctgtctccattatggccacatatgctttcggagtctgaacagtatcacctcctccagaaagccttatggacctacttggagaggctagacagggaaggactactgagaagatgctatttaagaccaggccgggcctgtaatcacagctacttgggaggctaggcaggagaatcacttgaactaaggaggcggaggttgcagtgagccgagattgcaccatgcactccagcctggggaacagagcgagactccatctcaaaagaaaaaaaaaaaatatgggccggaaggatgaggagcacattcttcagaatacctgccatgcctttaaaaacatatatcaaaattgactttagcctttgccattttcccaaaggtgctcgctaagggttgtttggtcatacacagctggctactgccaccttatggcaaaaagttgaacagaaacttccatgcataaattctgcgaacttacaaaagcctgacaattttccagttcatctcacctggtacaatgatgaattattctgcatttgatctaagattatcacctcttcttatgtgctggagaccctccctctcacctgctcaaagatgttgttcataatatttccctttatcttgcatcaccgacctcatctctctattgactcattctcaccagcactcaaacctgctgatagaatatctgaaacaaagaaacaacaaagaccttcccttagccctacctttctctagttaccaccccactttctgctctccttgatggcaagcctcttcaaaagagttttctatacttgtcatcctcacttctgttttcttatctcttgagtctattctcaatcagatttgccccagcactccactcaaatctcagctaaggccagaaatggtttccacactgccaaatccaatgggggagtctcagtctcgccttgacccaaccataggtggcgttgctatctcccggttctccctccacttcacagctgttccttctcactatctgtggctcattcctcctcttacctctgagctttaagcatggaatgcccacagttcactctttccacctcttctctgtctgcattctctccctaagtccccacctccacttttttttttttttttttgagacagagtcactctgttgcccaggctggagtcggtggccgatctcagctcactgcatcctctgcctcccaggttcaagcgattctcctgctcagcctcccaagtagctgggactacaggcgcccgccgccacacccagctaatttttgtattttagtagagatggggtttcaccacgttggccaggctggtctcaaactcccgacctcggtgatcctcccgccttggcttcccaaaatgctgggattacaggcgtgagccaccatgcccacctaagccgtttttgtactgactaatccaaacaccaccagcttttccccctgaattcagactggacaccaccacttggatacccaatctgattggcatctgaaagcaaatacactaacagcaatttttttatttcttctccacttcccatcctaaacagcctttctctggttttctcatctcagtaaattgcaattttattcttccagtggctcatctttcactctttttctctatccgcctctaatccgttggcaaattctactgatttcagtgttttcccatttcttactccacgcttgccatcagcctaatcaaagccagtatcatcccagacaatcagaaaactttctctgggtctgtatgcttccagcttgtctcccatcttgtctatttctctgtgtaggagccggagcctgcacggtcctataataatgaaggtaagaccatgtcacttctctgctcagaacctccagcgggtccccatctcacacagaggaaagtccagatttctcaccaagacctaaagcccgcatggcctgtgcccacccctcgctctaacctcacctcccaccgtggcctccctcaccatcctgcatccactccttgctccccaggtgcatgaggtttggtcccatctcatgttccgctcttcctcctgttgaaaatcttgttcttcacgtcctctggttctctattccagagtatcttttcagagccgcctttccagaccctcctatttaaaattgtactttctccacccttccccttccattgttttcccctgtagcactttgtagcctaacatagcttatgagattgtagtttcacaagcgcagggacttggtttctctgctccctgctggatgcccagtgcctggcaatggtggacgcgccacagctatttgtcagatgaatgaatgaggaccagtgtccaaggcgtccaatttcgaaaaaaaaggaacatattctctctaacctgtatacgtctggttgactaagcaacagtattttaaatcaatttttaactaattgatgacttatttatatggagaggagcgccattgctcattgtttctctgtcgggacggagacagcaaggcagattttctctgtcctggaagaatcaggtgaatacatttgtttctgtggacgtgcagcaagctttgtcctagagggtgg

SEQ ID NO: 5003 - DNA, 48986 bp, Homo sapiens
gacacatgaaaaaatgctcatcatcactggccatcaaagaaatgcaaatcaaaaccacatgagataccatctcacaccagttagaacgacaatcattaaaaagtcaggaaataacagggctggagaggatgtggagaaataggaacacttttacactgttggtgggactgtaaactattcaaccattgtggaagacagtgtggtgattcctcaaggatctagaactagaaataccattgacccagccatcccattactgtgtatatacccaaaggattataaatcatgctgctataagacacatgcacatgtatgtttatagcggcactattcacaatagcaaagacttggaacaacccaactgtccaacaatgatagactggattaagaaaatgtggcacatatacaccatgaatactatgtagccataaaaaaggatgagttcatgtcctttgtagggacatggatgaagtggaaaccatcattctcagcaaactatcacaaggacaaaaaaccaaacaccacacgttctactcataggtgggaattgaacaatgagaacacttggacacaggaaggggaacatcacaaccagggcctgttgtggggtggggggagcggggagggatagcattaggagatatacctatgtaaatgacgagttaatgggtgcaggacaccaacatggcacaaatatacacatgtaacaacctgcacattgtgcacatgtagcctagaacttaaagtataataaaaaaattaaaaataaaaataaacaaaaagtcttggcagcaacgattcatagtaatttatttatttatttattacttacttatttatttttgagatggagtcttgccctgtcgcccaggctggagtgcaatgtgctatctcagctcactgcaacctctgcctcccgggttcaaacaactttcctgtctcagctcccgagtagctgggattacaggcacccgccaccacacccagctaatttttgtatttgagtagagatgggggtttcaccatgttggccaggctggtctcgaactcctgatctcgtgaccacccacctaggcctcccaaagtgctgggaattacaggcgtgagccaccgcacctggcggtaattgatttaaatgatcatgctagggtatttgttagtgccaggtatatgttttcaattagtaaagcacttcggatgtttcatctttgcaaaattacaagttaaacttcatattaccgttccttgtggaaccaaaatttagtattgccatacaacctattttcgattttcttttgtttccccagaaccttaactgttttgacctgaatagttttttgacaggaacattgaatgcaaggtactcactgtgggcaaatttttcctgagatgcccaaactctgactatcattgaagtatgagtgtaaagtgcctgcatcttcccataatgtgtggcatttgggttagtttatatttcttcttaaaattacaaaactgagtttaatttaattcaccttattcaaaaaaaacttgcgcaaacataggaaatctttgatattgggcacgcattcattcagggaccaaccttgactactttcctttcatcagtaattatcgtgggtactttatctctgcatttcctgactcaaagcgataacatctccaattcatggttacgctaatatagtttgcatttatcaggtaattagttcaccttctagagtagctgagtcacaacactgtagtcagtcttttttcgctttaccacatacggaaatagacaaatcatttcagcacccctacctgaaactgcctctgggtaagctgaagtaggtcacaactgataggtctgtgatgagaggccacgatttcagggtaccctgtcaccgcttattagatttaaccttagcctctctaaaacaaggctttttttcttgttgttttaataaaatttgccgacataataaaactaaacattttgaagtgaataacatttaaatagcataatgaaaacttcacagaccttatgccatttaatctgaaaactaaattggtgagtgatcttatctgcaagatgaggaatacaagctcaaagttcaattggcttgctcaaggtggagttagactagaacataggctactataaccccaaagccagttgttcccaaactacctatgagaattggaagattacacatatagattcctaggccgtctctgcatagtctccctctgtaagtctttgttatttgtggcttgtttttattttctaggtggacttcagccaagaaaataaactaaccaaaccatttgtataagccaaggaatatgtaagtggtataataaatattaaagcagctatcttgagctggctttctgaagtagattgttttctctgtcaggcaagtgatatggaaagttaggagagactgaggcagtagctagtgatgggcttgtaaaccgcctcccagtaaatggagaagccctaatttatggcatctgttgatttcagtggtgtaaatactcccaccatggccatttctaactactgataactttaacaacttgctcacaacattcttatttaatgattggccatgagttagctccagcataatactggcatgtagactgtataggggagaaactgaacaattcccagcattatctaaattgtccattatgtggtctgaattggtgtaaactccccaaacttactctacctgttggcctcatgttctgatttccaaaggtggcttagtgtcccccaagtctcatttctcaatttccagatatgctttatatggatatagggcagaatgaaactacggaggagactagtgggtagagcacttcgtagaagagaaatggatgccatctttaagatgactatcctttgctcttacctgccacatggcaggagtcacaggatggggagctgcctcctgtaaagagcctcagggtgggaatgaaacatgacatatgatttaaagaagcttggctctaagctgagagcaaagggctgggtctttctgtgcctccacttgccatgggagaaagacacgtatgttagattgcagagtcaacattagcaagaaagttcatcagcacggagctgaagagatcatagcctgcttttagtccatgagtcaagctcatggggcaagttggcttctcagagacccctgtgaccagacccattggtgcacaaccctagctagtccaatgacatagactgttgtttgcctggagtaatctctatcagcagaatcaccttgggaaactgagtaatggtggtttgacaactgggccctgagcacactaacatgactaccactttcagatgtaaaagtaccaaaaacaattccaaaaccaaatagaaataattctgggatcatctaccattttacattatttgttccttggtaaacttccagaagtcaggatattttctggatgtctgatatgtgcatgcacaattaaacaaaaatatataatccatccttgagctccctaagtagccaacttcaacacttctctcttaaggacaagcttgttttgaatattaatttgctttcattctggttgaatccatttgtcaataattcaatgctcacatattctttttcccgactagaaaaggtagtcatttatcttcaagaaggcaaagtagaaaattaactcccaaatgaatcaaccagagagagaactgaatcaagtgggacttgcaattttagcatacacacttcaaaggagttagtgtgggtggatttcgataaggaggcctagatttaattcaccagccttcagatcttgggccagttatttcatctaatcggtcttcccatctgtaaaatgatatttatgcttaaatctcatggtaacatttcctccatgtaccaagcatatttatcatgttatttatccttaatcgtcacaactatccttcaaggttaattttgagttcagaattccatggggatccagagatgagaccagaaattaacatgcgaacctcccatgtatgtgttttggtgcatttttataagggctctcaaacacggatacactagaatctcaacacctggggtgaagatgggggaggggcagagaaaaaagcaggtaggtgttgcattttagaaaaaccactcgttgcagttctgcggttggctccccagtgtggcttgtggatattaatttagacgaaaagatcaagctaccagtttataatatttatttgagtatatatgtatactcaaagcagaagttatattcaagatgaataaaaattgaattacctggatatttgcagagaaatgaaagcatatatctacacaaagacttgcacaccaatactgatagcagtttattcattataatcccgaactgaaaacaaccccaaagtccaccagcaagtgaataaagggcaacatgcgcaccaaaacatggatgactctcaaaaatattatgctaagtaaaagccagcataaaggatggctccatttatataaaattcctgtaaactaatttataccaacagaatcagattattggttgccttggggaccaggggtggaaggacagactgactgcaaaagaatagaagaaacttttggggtgatggaaacataatgtatcatgattgtggtgttagtttcacaatgtgtacatctattcaaactcactgagctctaatttttttaacaactgcagtttaaagatgccttaataaaactaataaaaatttgaattagcaatcccagctcctgaatactagcaatctcaaggggcagttgtcatgtaactaagactactcaccaacccaaatgcatgtcttcgagttacccttagtatgagcaattaaaacactactgggccctcaacactattctctccctgagtcactgaatagggtttttaacagaagcagtcaataactgcagagctaaattgttgatagagactgggttcatgaccttgtccccatgagaactatatcctaatccttctaacactgatagatcaagttcatgtggtttgattcactccagtgggtgtacccagattttacatcacagcttagataaaatagactgagttatgcaaaattccctgcaagctagctctaattccttctttaccatacatcagtggtcagccattgaaaactctgtcctaaccaactagactaacaacctttgaggaagaggaaaatatgtatctagagaggtaagttccaaacctattttacattaacatgcctcagttcagatatgtatagaagccaatttgtgttctaaagtccacttaactgtaatttcaaacttttattttcatatttaatgccttagtagcctttaatgaacaaatagtttaaaggtcagtggaagataggcaaatatttgtatgcctacagttctttaaaactcatgataatgtaagatctttaacaaacttattgtgaaccaacgatttgcaaatgcactttgaccaattatcactttagaacagattgttcacttgttttctaaccaataagcatgaatttctgtatattttagcttcagtactttctatgtattactgtaaagattttatgtaatatgttgtaaaatccatattttttagaaacttaaatttatcatgatttgcaagataaacagttgacaacagaacatgtcccatgagtgaagaaatatatttaaaaagttttgtgttaaattctgtaaatgagtctgccttggaaattctttgtcccacatttgtgcgaaaatatcacagattggctccattccattctgacagctgcaaaacaagtataactgttcattaacctgttagagtagaattcttctacaagataattatttgttccatgtaataactttctggagaagccaacgcacttgatccatttttatttcaaaatgtctacaaagttttaattctccattatacagtaatttttcaaaatctagacattattcaaatgtaagccaaagtccttacacaaatagatacactcaaagatcaaaaatatacatatctttcagcaaactttgttacataaataagaaaatatatacagctggtgttttcaaagtacaattatcttaacactgcaaacatgtatagaggaactaaaataaaaagaaacactacagcaaaggttaaaggaacaacaaattcattttaaacatcatcaattataaagatacatatatcaaatcttaggggaatatatacttcacactggatcttaacttttacttcactttgtttatttttttagaatactctctggataggtgaaatctatccatgacacctattacgaaagttacatgtgaagaattcaataatctaggtcttgtactctgggatagatgtaaaaagaattctttaaaagttaaatttgtataagcctatgtaacaatttccaagtaaactgttctattggaaattaaatatttcaaagtagaaaacgttagaaaaacttcactcaaaaaattttaacacagtaagcaataaagaaaaattatgccaatgttccttagataaaggcaactcagctaggtttatgttttaccccagaaattctccttcctttcttagctcgtgccagagtttgaaaagcccggagactagaagctgcagagcgagcagaatctcagacaatctgtcctcatctgcaatgaaaaaatcccgagattatattcattgccaaaatatctattaaataaacattgtgttttatataacagaaaattaaaagcatcaaactggttatcaatgtcaagttagtcaggaaaaaaagtaatctactgaaatgtaagatactaacctctcatgatacctcacagtagttttccaggtttatcatatatagaaatcaaaccttttatcttaacatttatcgttaaatttttttccttcttgaaatcccgtcattaacagagcaccggcctatgatttcagtattacttgaaaataattcatcataatactgttttatcctacttaaaaagcacagctattctgagcaaaaagcttttctaaactttttaaaaacaaaatgcctaccttaacatggcatttacatcacatttctaaaataatctcactaaatgtagaaataattttgattttaatatgctacccttccttaatactgaaattcctcattctgagtaagcaatcttttataaggttatttatagacactattcttccattagaaagaaaaaaggactggatcaaagttgtcagacatttgcatttcaaaacatacaacttgatttctagctcaatgaatttaacaaaaagtcctaaacctgctaaacggaaagaaagtctttaatgtatgatacagagttgaaatttaaatttacttccaattcaaactttgtaagttcagtaattccatacttcttagatgaattaaaatagtgattcaattattcatattgaattcaagtctcctgccactattaaagcaaataaatgtcagaataaaaactacaaaaggctgggcatggtggctcacgcctgtatcccagcactttgggaggccaaggtgggcggatcacaaggtcaggagtttgagaccatctggccaacatggtgaaaccccatctctactaaaaatacaaaaattagccgggtgtggtgcggatgcctgtaatcccagctatttgggaggctgaggcaggagaatcgcttgaacccggaggcagaggctgcagtgagccgagatcatgccactgcactccagcctggcgacagagcagactccgtctcaaaaacaaaacaaaacgaaacagcaaaaaagaataatgtcaattttcctaatcatgtatttgtttgaccatggaaaattgacaaaaatatataggcatttttttaaagatggatgtaacactaggccaaattcctgagcccccagctagacaaggtggaaaaagaaaagaacactgacctcagctgtgatgtcaggcacaatctcttattgtatgtttgccctaaacagttttttaccactttactcccagcttactcatttgtaaatgggggtaatttcactcccctcacagggtttcaaggatctaatgaaaaatctgtggaagtacttcataagctataagtgctaatcaaatgtaaagccattatactctcatagactagaactcaaacttttatgtatgtgactactgaaataccttcatcattaaaggcttcatgttgaggtaactgcaaattgtcatccttgcttttcccacttaaaaaaaaaaaggcagaataaattatccttcaaaagccctgaacagcttatctcaattatatactaaactgttagtaaaagtaggctgtcagaaatttattaattatcaaacctacatgtgagtaaaggtttaagaaatgaaaaagattttattaataattttatatcttaatagaaattaccataaaagggccattcataatttataatgcactagcaagcatgtaaacaaactatggataacttcctaatattctttccaatgataatattgtctattctaactttaaagaaatgtagtaggcttctgattagagatggtaaattaaataccgcatttacaagaagaacaaactcataggacaaagagaatgggagcaaataagacagcagaaactttttggaacatggaaagcaaatggaagagcagtgagtgtataactatacccaataagtggaagtttaagccagcagaagagtgaaaccaagaaacaaccaacttgttcccctatggctctgggtttgggcatactgagtaccactgaaagttggagtgaagggaagactgaccaggaagctgcctaaatatgtttttacaaaaatagttaatatgccaggtcctcctttaatttgcacagctgggtagttccctctttcccaaagaggcatggaagtttcgtctctaaagtttaccagagatactttgactgaaggataccaggttcaactgtgggcaggggtaatgtttcaaaacagaggcattatatgtatcattttcctcttcaaagagataaaacattccattatgaaataagaatgggatgctgtataaaagcaatatgcaatgttcaaaaattcttagaattaaaaagagcaaaaatctttttaaaaaactaacagacggcatgtggagagtcaaagagagacccacctaacccagcccctgcctggctgtgcccctccacagcttaacaaaaacgactaaacttttgggagttttataaccctgcccaggtgtgagaagccagaatacctcccctggcaacacagggcaagctcaattaccactgctactactgcagctggtgctcttttgcaagagcacctcctgattagaggccaactgacacagtccattatatcatctctaggtagaatacgctgtgcccagaaaaccagtgcctgacctcagctatcaccactgcctgcaacaccctactgaccagtggtcctgaatctgtctacgtgacaagttcacaactatcataaccaacacgaagaaagccagcaccctaagcctatctacaaccaaggaatctcaggagtcccagatcttccactggtgggaagtttctttcagcagagacacaattgcagtgctaggctcagcagggatctaccccatcaccccaacagtcaggcaagcttagtgctcatgaagggtcttggagaagggtcttatttccccttgtccaccactgcagacacagctgggacttctcccacaggactcgtatgagtgtgcctatagacagccttcctggaacactttagggtgactgcttccccacagaggagcactccccagatgcaggcttgcatgagaggcagagtcacaattcctatctactggatagcattctcacccttcaccctgataagacctcactgcatttaactgagagctccccagccaccttcatcaaggctgggacctgtgcccaccagtgggtattgcattcacccaccaccttagccacagtaagttcctacccagggatacctcccctaatggcctgaagcctgaatatcaactcagtaaacaaaatactggagaaaaattaaataaatgaaaaagtacacaccaaggggaatgagataagcttcaagagacctctgccattccaaccccacaggagacagcgacttgccgacacactgagtacacagctactacaaccagcaactgaggaagccatcatacaagactctctataaccaaagaacttataaagactcttcacccctaaaagcaccaagaaccaattaaactataacaaattataatcattaaggtcacattcttaagaggggaaaaaaatttaaaaaaaacacacatagtcaaatcaaaaataaatttgagaacaattagaatagtctaccaaaaaagaaggaaccagaaagtaattctagtaatatgacaaaacaaggttctataacacctcaaaagatcacactcactctccagtaactgatccaaaccaagatgaaatctttgaataccagataacaaattcagaaggttgatgattaagctactcaaggagctaccagagaaagtgaaaaccaacataaagaaattaaaaaaaaattcaggatatgaatgaaaaatttcccaagagatagatatcataaagaaaatgcaatcagaacatctggaaataaaaaacacacttaagaaatacaaaacgtagtggaaagtttcaaaaatagactagaacaagtagaagatagctcatgccaggtccaagagggaggaaaaagcagaaaaaagaatttcagagctcaaagacaagctttcgaattaacccaatcaaacaaaaataaagaaaaaagaatcaaatgaaatgaacaagtctccaagaaatataggattatgtaaacaaccaaatgtaagaataaatggtgatactagggagaagaaaaggctaaaagtttggaaaattcctttgagggaataattgaggaaaactccctggccttgctagagatttaaatatccaaatacaagaagctcaatgaactcttaggacttcattgcaaaaagatcatcaccaaggcacatagtcatcaggttatctaaagtcaactgaaggaaagaattctaacagttgtgaggcaaaaagcatcaggtaacttacaaaagaaaacaactagactaacaacagacttcccagcagaaaccttacaaggcagaaggcattggggcctatctttagcctccttaaacagaacacctatcagccaagaattttgttagtttagcaaactaagtttcataaatgaaggagaaataaagtctttttcagacaaacaaatgctgaggatttgtcactaccagaccagcactacaagaaatgctaagtaggagttctaaattttgaacaaaagcttgatatgcaacaaaacagaacctctgaaagcttaaaactcacagggcctataaacaacacaacggaaaaaacaaagtatctaagtaacaactaacacagtgaatagaacatacctcacgtctcaatattaacattgaacgtaaatggcctaaatgctccatttaaaagaatggaatggcagaatggattaaaaaccacaaaccaaatatctaatgcacaaagattcattaagctcaaggtaaaggggtaggaaaagatattccatgcaaatggaaaccaaaagcaagaggagtcttatatcaggcaaaacagactttaaagcaacaactatttaaaaaaagacaaagtcatcatataacgataaaaaggtcagtccaacaagaaggtattacagtcagtcctacattatatgcacctaacactggagttcccacatttataaaacaattactactagacctgagaatgaagtagacagcgacataataatagcgagtgacttcaatactccactgacagcactgacagatcgttaagacagaaagtcaacgaagaaacaatggacttaaacaatactctagacaaatggacttaacagatatttacaaaacattctacccaacaattgtagaatatacattttctcatcatttcacatggaacattttccaaaatagaccacatgacaagccacagacaatctcaataaatttaagaaaatcataccaattatcttctcagaccacaggggaataaaacagaaatcaactccaaaaggaatcctcaaaactatacaaatacatagaaattaaataatcgctcttgaatgattttagggttaacaatgaaatcaagatggaaattcaaaaattctttgaatgagtaacagtgacacaagttatcaaaacctctgggatacagcaaaagcaatgctaaagtttatagcattaaatgcctaccttaaaaagtctgaaagagcacaaactgacaacctatatcacacctcaaggaactagagaaacaggaacaccacggaatactaatcctccattaaaggaatgaaataatgtcttttgcagcaactaagatggaggtggaggtcattattctaaatgagtaactcaggtatgaaaaatcaaatactgcatgttctcacttaccagtgggagctagctatgaggacacaaagacatacagagtgatacgatagactgtggggacttggggtggggaagggataaaagtctacatgttgggtacagtgtacactgcttgggtaacaggtgcattaaatccagaattcaccactatagaatacatccatgtaaccaaaactacctgtaccccaaagctattgaaataaaaattttaaaaaacacaaaagatagaagataaaaattagtaacccttcaaatttaaagacagagatggaaaacaggagaggtaagataaaaaataaaatcatgtcaacatctgaataggagccctagaaagaggaaatagagaaaggagagaaatttttttttttggcctcccagacttaagcaattctcatgcctcagcctcccaagtagctggaattacagtgtgcactaacacacccagctaatttttttgtaacagagacagggtttcatcatgtgaccaggctggtctcaaattcctggcctcaaatgatctgcctgccttggcctcccaaagtgctgggattacaaacatgagccactgtgcctggccaggagaggaaatttttgactgaatattcaagaaaatgttccagaagtgagaattttccagattgaaaggtctatggagtaccagaaaatgaataaaaaaaataatactctctcagaggcacatcataaaatttcagaacattaatatgaagagaagatcccaaaagctgccagaaagaaaacaccacacatagaagatccagataaaaggagcatctgacttcttaacattaacgatggaagccagaaaagagctgagcaagcctactaacactaaaggaaagtcatttctgactgtgaattctacacccaggcaacattggcaatgtctggagacatttttggttgtcacatccagagaagaggtgctactgtcatcttctagtggattccctgtatgtgtatgaataagaacttgagagatatctcacacatatatacagcaaaaagtgaacttaggtgcagcacaattggtcccaaggagggagttttcctattaaagaaattttattaatacattaaccaaaaatactaaataactgatttattaacataaatgcattcttagactttgtacctatcagcataacactttattttaaaagacaaaaaattaaaccaaaataattaccattgtgctgaaactctggatctctaagagagccctgaattcgtgagagggatgccagtaggatggaacatgtggtggagaaggcaactgtccagggggatttttgggtattttggaatttttgaaactggaagagttgcctcagcaaatttgtggatattgcttcagaatcttcccgcaaaggcagaggatcaactgtttttataccagcagctggagaatcagtagggatacagcacgactttctttctaaatgacaaaaaaaaaaaaaaaaaaaagagcctatgtgtagatatgtaaataaataagccaaacatttaaatgcaaaaaacataaccaaaagcagaaggagaaatatgagagaatttatgcaacatctatgtggggaagatatgataagacaaacagacctggctatataaacaaaatacgtagacattttaaaaattaaaagaaaatgcagaacttggaaaaaatacaacttttatgactgacaatgaattatcattgctgcatagtatttctttaaaaacagtaagaaaaatataaacctaattaaaaagtagaaaaaggattgaataagcaattcatataatgtacacacaaatcacaaacagcaaacgtattcttccttctaatgatcaaataattataaaatgaaagcactgagatattaatttttcacgtaccaaattcaaaaattaatttttaaaagcacaatgataccagagctggcaaggatgtagagaaacggcaacctcatagactgctattgggagtacaatctttctggggggccggcaaaacatagagaagccttaaaatttagcattctttgacttctttgactacacaataatacttggggagactcacaaacacaaaataatataaacaaaaatgtagttacagatggatttctttacagttttcttcaaaacagactaagaaataacaatagaaatttgagtaaaaattagattttaacataagcatctggttttaaaaaactgtggtgtaactatagattgcacgtcgccataaaaaaagattatgaatatttcatgatgtgaaaatatgttaacagtgctaaaaatagattataaacctttctacactatgataaataaataaccaaatatactaacacatatatacctaaatactcaaaaatttaacagtggatgtccctgaacagtacatgtgagatatttaccttctttttagtttggtcagtatttgctgttttccacaatgactatgtatcactgtcctagaagtcagaacaattttactttttaaaagaaggcagctagctggacacactggctcatgcctgtaacctagcaatttgggatacttgggtggccaaggcacaagaattgctcgagctggggaggcgagattgcagtaagccatgattgcatcactgcactccagccaggaaacggagagagacttctcaaaaaataaaaataaaaatggtccaggtgcagtggctcatgcctgtaatcctagcctttgggaggccgagacgggaggatcactttaggccaggagtttgaccagcctggtcaaacggcgagaccccatatctatttatttaaaaaaaaaattaaattaaattaaaaacaaaaaaggcaaaccagtaaaatcaagtacagttccaaactttcctgattatttcttgtaattgtgccttcacttattatctttgattctatcaatgtaacattcaaaacattgctttctaaattagatatcattttctgtgattgcagagcttattgcttcaaactggcctagggctgttatctcaaccaataaacatacttcaaatcaatatgaaggataaaaccacaaatcttccactgttttcctttttaaacaagtatcacttagtacaatacaaataattccaaagagaaattgtctttttttttcctttttctatatatatgaacaaaatttgtgatctctgtaaaactggtttacaattgctgaaaacaccggaaagaaacctgtaaaataaaagacatggggttcccagtttaacgtaactgattctgcgatctgtttttgagcctaaatcctcaaaaggccaataggctcactgctctactcagccctgtgtacagcagttctccactgaggagccacagtgacttatttgccctgtgaatcatatcctatttgctttgttgcttctgatattccagaggtttccagtgacatcagaataacatccaagagaataaaccccacttgattataatgaattatcttttgatgtgctgctggattcagtctgatagtattttgttgaggatttttgtgtctaccttatcaggaatattggtctacagttttctttttttgttgttgtgtccttgccagattttggatcaggatgatactggtttcgtagaatgtgttaaggagaaatcctttctctttgattttgggaatagttttagcacataaacagaattaaaaacaaaaaccatatgatcatctcaataatgtagaaaaagcatttgataaagtccaatatcccttcatgataaaaatcctcaacaaataggcaatgaaggaacatacctctcaaaataataagagccatctatgacaaacccacagcaatatcatactgaatgggcaaaggtgaaagcatcccccctaagaacaagacaaggatgccactctcaccacctctattcaacatagtactgaagtcctacccagagcaatcgggcaaaaaaagaaacaaaaggcatctaaatagaaaaagaggaagtcaaattatctctgttcactacaatatgattctaaacctaaaaaaaccctaacaatccctccaaaagacctgataaatgcgttagtaaagtttcaggatacaaaaattaacgtacaaaaatcagtagcatttctacaaccaataattcaagctaacaaccaaatcaaggatacagtcctgttacaatggccccccaaaataaagtacctaggaacacagctaaccaaggaggtgaaagatctccccatgaactacaaacactgctgaaagaaattatagatgacataaacaaatggaaaagcattccacgcccatgatcggaagaatcgatattgttaaaattgccatactgtctaaagtaacttacagattcatgcaattcctatccaattaccaatgtcatttttcacagaattagaaaaagcagttctaaattcataaggaagcaaaaaaaaaaaaagggcccaaagcaatcctaagcaaaaaaaaaaagaaaaaaaaaagaacaaagctggaggcattacattacttgacttcaacctattactataagttacagcaaccacaacatcatggtactggtaaacaaacagacagactaatggaacagaaagagaactcagaaataaagccatacacctacagctatctgatctttaacaaagatgacaaaaaaaatgaacaatggaaaaaggacaccctattcaataaatggtgctgggaaaactgctggccatatgtagaagaatgaaattggacccctatctctcactatatacaaaaattactcaagatggattaaagacttcaatgtaagacctcaaagtacaaaaatcctagaagaaacctagaaaaaactcttctggacattggctaaggcaaggaatttatgactaagtactcaaaacaaatgtaacaaaaacaaattgacaattgggacttttgcacagcaaaagaaactatcacagagtaaacggacatcttacagaatgggagaaaatatttgcaaactacatatctgacacggactaatatccagaatctataaggaacttaacaagaaaaaaacaactccattaaaagggggcaaaggacatgaacagacacttcttaaaagaagacaaagcagccaacaaacatgaagaatgctcaacattgctaatcaccagagagatgcaaatcaaaaccataatgagatatatctcacaccagtcagaatgactattaccaaaaagtcaaaaaataacagatgttggcaagatgcagagaaaaggaaacgcaacccctttggaaagcaatatgaaaatttctcaaacaataaaattagaactaccattcaacccagcaatctcactactgagtatctacccaaaggaatcattctatgaaaaagacctgcactcataggtttattccagcactattcacattagcaactcatggaatcagcctaggtgcccatcaatagtggattagataaagaaaatgtagtacaatacacaccatagaatactgcgcagccataagaaagaatgaaatcatgtccactgcaacacatggatgcagctggaggccattattctaattgaattaacacagaaacataaagtcaatactgcatattctcatttataagtgggagctaaacaagaggtacacacaacataaagatgaaacagacaccagcaactacaaaagggggagaagagggaggggtgcaagagttgaaaactacctattgggtacaatgttcactatttgggtgatgggttcaatagaagcccaaacccagcattacacaatataccaatgtaacaaacttggacataaacgctctgaatctaaaataaattcaggctgggcacagtggctcaagcctgtaatcatcctaccactttgggaggccaaaagggaggactgcttgaacccaggagtttgagaacagcctggcaacacagcgagatcccaactctacaaaaaattttttttaaaaattagccaggcatggtggcacatatctgtggtccagctactcaggaggctgaggtgggaggattgcctaagcccagaaggttggggctacaagagccgtgattgcaccaatgcactctggcctgggcaacacagcaagaccttgtctcaaaagcaaaaaatgggccagatgtggtggttgtaacctgtaatcccagcactttgggaggccatgcaggtggatcacttgaggccaggagttcaagaccagcctggccaacatggcaaaacacatctctactaaaaatacaaaaattagtcagatgtggccacaggtggctatagtctcactatttgggaggctgaggcatgagaactgcttgagcctggaaggcagaggttgcagtgaccaagatcgcaccactatactccagcctgggcaacagagcaagaccctgtctcaaaaaaaaaaaaagtgaatataaaattaaattaaaaaaaaaaaaaagaataacatctaagatcctactcggcctccctttctaatctcatttcctgccctctccccttccctctccaggctccaccacacttttaatctctctgggttcttgccctagggaaaaacacttgcacttgctgttcttcttttttttttttttttgagatggagtctcactctgtcgcccaggctggagtgcagtgcgcgatctcagctcactgcaacctccgcctcccggattcaggcaattctcatgcctcacctcccaagtagctgggactataggcgtgtgccaccatgtccagctaacttttgtaatttagtagagacagggtttcactgtgttggccaggctgatgttgaactcctgacctcaagtatccacctgccttggcctcccaaactgctggaattacaggcatgagccactgcgcccggccctgttctttctaattggaaaacaatctctgccccagatctctgcatgggcaccttcccatcagtcaggtctcagctaaaacgtcatctccttagaggtgcctgtcctgatggcccaactaaagctgtcttacccatcccttagagacctgtagtcttatttaattcacagcgcttctactatgtgaaattattttcttaaaaaattgtctattcctcccaatgaaaatgtaagctcatgaaggcagggattttgacctgattatcaataaatcctcagatcctagaacagtgctggcacttggtaagagcctattaaatattgaattgaatgaatgaaaataaaactaccctcaaagaggctccttgtccagagttctcttgctcagtgcatggtacctccatcaatcttgtgggcaagccagaaacttagcaggcatccctgtctctcatccattatccaacccagcataaccttaacattgttccccttacataattgtgcagtttcatccacttctgtctattcctccctccttcatccaagctaccaacacctcctacgtggactactgcaatggccttttaaggcattcacagcctactcttgcctcctatggcagccggacagatcttgcaaaacatatatcatcacaattcccatactgaaaatatttcaatggcttcccattgctcttgagataacgaagaaatcccaatgttgccatgttttccagcctcatgttgtaccaggctccctgccacacctgtattggtctttgtttcctcaaactctacattgtttctctccacaagatcttggcattgctaggctccttctccccatccttttttcctggttaatgcttcctcttctcctttatctagctcaattatgagtttttcaaagaagcatcattgacttccaagaaggtttctgatctcatgattagaacaattccttccagaatagtgctaagtacttttattttgaaactcttatagttttaatttcatttcttttttggtgtgattaacatgtatctcccttaccagactgcagtttcataagattatgtaccatgtctgtttctatccattatcattgccatagcatgtggtaaatctgctaaatgaatgaagtgagcaaatccacacttgggtttttaatataaagattgaaaatgtttcctgatgatcaaaccaatatgagaattctaccctaaagttttgggacatctgataatttattggaaattgaatgacctatgggtttaattttatacataataataacgaatttcttatcaatgcttttataagagaatataaggggaaaaactgatggtgtatatcaagtttagtgactcctctgcctaccagtaaccaaggggtagacactgggaaataaccaaactagctagctcctggtatagtccctggtagtgctggtcgcagaaaattcacatggaaggtatccaatcaagttgtcaataataaacttgtgtacgtatgtacatatgtatgtatttatggtttggagagagtcttcctctgtcttccaggctggagtgcagtggcgtgatctcagctactccaacctccacctcctgggttgaagtgattcttgtgcctcaatctcccaaatggctggattacaggcatctgccaccacgcccagctaatttttgtatttttagtagggacaagattccccatgttggccaggctggtcttgaactcctggcttcatgtgatcctcccaccttgcctcccaaagtgctgggattataaacatgagctaccgcaccaggccagaaacttattttgaggagttggtaattaaaatgttaaaagtgtatagtactcacagtgagacagagaatggattaacattctaagggatgatattactctatttagattattcaataaattaattccacataagtgaaaataatacatataaatccagccacaaatatggatgagtcactcgttttggcgaatcagctgtgtgtatacagttgcctaaaagctcacaccttccagatggcagcctggattctaaggaggagtaaaacagtccattaagatctgattctcatgagtcctctgaccatatcctaatgtcacatttcctttaataaaccagtgtatacataagcaacaggaaatagtttgatattctgtcactccaataacattcattcaatctgttacgtgctatgagctggactctttctaagcactggggattaagaggtagagggtgctctgatcccatctcccacctgttccaatccctgaaaactcctactttgtactcaaattcacaaacagccatcagcaaaattcccatagattttcaaccttttctctgaatgttctctattctactccaaccacttacacccatatgttaagttaagccttgtcattactggtaactgcaacctctccataacctaaatttctaccaccatttcctaactttaaaactaatccccacaggtgccccaattccaacaagtctttattttacctagaccatccatccaccgatcctatcacctctgcactcttctcaagtcccgtgtccttccctcaccaactcattataatcccttcttcatatatacctcaactccattccctttttctcactttgtcttattctcatgacaaattcaaaaccctaggtaaatccaacttatctgataaaagtatcctgcacttctgcagccaaacattactggagaagggcacacaaccttcctgactggtcttctgccaactttgtgaccaccaacttaaaatggccccttaacatggcctaaaatatcccacattcccctggcccactcactctcccactctctgagaagactctctatgccttcactttcctcaaatctccaacatcttccccagccttattctcagtaagatctttcttcacatgtcaccaagaagcaataagaagaggtcttccaaaagctgccatcaatcttcctacattcatcagcagtgcctgcccatgaattctgctttccctcttttaacaaaaagaaacaatcagtgtctaaagccaacccttccatatctccaccagatcctaagcccttctcctactcaagagcatctttccaacaactttcccctcactcctgcatcatcaactttctctctccaaaattattcttgtcaacatacaaacatgctgttgtgtcttccatcttgtttcacttctctcaactactcctgcattactctgcttcccttcttggaaaagaaacttcaggaattatctgtggcagctttctccaattcttctcctcttttttctcttgaattcacttgacttaggcttttgtcccttccttccaccaaaactgccctttatcaaggtcaccaaagactccacgttgctaaatctgataagcaattgtcctatcttactcacctatctgtagcattgctctccctcctccttgacacctccaggataccagtctcgtttgtcaccacctcactggcgctctccttcagtctcctttgctgactagtcctcaacttcccaatatcaaaaaactgggtttagacctgtctacaactattcttctctgtctacacccacccccttgatgatttcctcagtctcaatactttaaaaacctgacccacctaagctataaagagcctcaaatctgtaccatagcccaacttctcctctacactccaaacctatatagtcagttccctattcaacatgttacttgtatgtctaataagcttctcaaatttagagtgtccagaacggaattcttgatctctccaactcagttaaatggcgactccatccttattgctaaggccaaaaatcttgagtcaccttgatttttctctttctcccaccccagatcttatccatcagcaaatcttgttggctgaccttccatgtgtatccagaattgaactttatatgaccttcactgccaccaccaaggtcaaacaaccatcacctcctgcctggatagagtaagtgactcccaactgtttttatgccccgctcttgctctactactacctattctcaacacagcagccagaaagaccttggaaaaaaataaataaaatcatgtcactcctctgcctttccaatagcttgccactgcatacagaaaaaattcaaaatctttgctatgatttacaaagccctacacaatttagcaccccattatgtcttgaacccattatcaacactactctccctctcattctctctctctctcttccagcaacaggaccttctagctgttcctcaagggggcaggtacccccttcacctgagggatctgcacttctgttcttgtcacctagaccttcccagatccgcatacaggtcaatcccttacctttttcgatcctgcttaaatgccactctcgcaccgaggacttccctggccacttcctgttcacttagcagctttatttttctccttagcactaatcagtatctaaaatactatgtattttacctgttattttgtttattgtctccctcctccactagaatgtaagttcaatgatggctatgattttgtctgtttgttctctgctatatccccagcacttaaaacaatgcctggaacatagctgaatacaactgtcacacagcagatgctcaatgaaagtattgctttctttatcttcctatgagtcactactgacaaggttgaaagtgtatcaacaaaaacgtaatgcttctaacagaaaaaagtcaagccttttgccttactaaaagcaggttaacagtatcatctcctcatatgataccacaattctctaaaatcttaacccatcattcatttattacatgtgtctacaataattatcctagatgagatgcttttttccccaaaacatgtttaccttagtaaaatcattctttgagtttctaaacaatcctgagaggtcattcttttcctctgttctggggctggaggcttcatttagatggagacactaaaacagcaccacctggaaaaataaagatgacagtttcaattacctaaattaacatgtagaaaaagcaggttaaataagaactgcacggtgtttgccgattacaacagctggagtagtgagatcatgatgagtcctctggattccaccaagttctctcagctgggagtaggaagccggcctcctttttctgaggatacagaagaatctgacctataaattgaacaatctatgaatctatacagcatttcctcgagaaaatatgataaaaaatactttgcctcattgtgcaataataaagtataaaacttgtaagaggccaggcgcggtggctcacgccctaatcccagcactttgggaggccgaggcgggcggatcaggagatcgagaccatcctggcaacatggtgaaaccccatctctactaaaaacacaaaaacaaaattagctgggtgtggtgcgggcacctgtagtcccagctacttgggaggctgaggcgggagaatggcgtgaacccagaggcggagcttgcagtgagccgatatcgtgccactgcactccagcctgggtgacagagcaaactccgtctcaaaaaaaaaaaaaaaaaacttgtaagagaaggccattttgtttctgaaaaaataaccaccaaatccacatgcagttaaaagcgactgaaatttccaataatgaataaactaagcacaagatcaaaaataaaacagaacactgaaaaaataatataagctatatcactatatcaatagaagaaaaacaacccacaaagaaaaaagtgactgaatactggataatgggaaaatcactgccaagtcagcaccggcacagcagagaatccttcctcacatcaaggctaagttccataacatccatgaatgaataaaggatttagattatagacaaaaggcactatttcataggtggagaagagccactccccaaagcaatttacacataaaacaacaggaattagtattttcagaaatcactttttaaaaaatattataaaacattatcttttttggtagaatctctgatattaaagaacaccagtttttttctttaaagtcattcttccagacacatttgcaatctggcacaccataaattataggacgtaaatgaaaataatcctaactacttcctcccaagtaggccagaattcaagtattcaattaccaatcactagtgacttaaatacctgagtgatcaaattattcaccatacagcagtgcctcctttgtgacattgaaataaaatctgcaattattagtcataaaatcaaaagagtaaaccactatatttagtgacaaaatacatatcaacctgtaaataacgcttctctatactgagtaatttaaaactctcacccttctttcatcttattgccttagatttctcatgtacatccaacttctcttgctctcccataaaagcctgcttgccgttttcctgtccccttcctcttcattgtcgtcctcctcctctttctccccgggctgttctgtacgtcttcacttgtgttctctgtatcccaagccagccgccttctaacgggtatgggggagctgacacacccaatttctccgtggtatttttctggggctgttcttccacgatattcctttttcttctggttctgtagaaggacatttctgcaaagtcttatggcttgtaggattctgcgtaacaaaatcaattttattttaaatgtgaatagtttgcacttttctaatcaacccaattttagtgagtccatcatttccttctactgttcacaactacatgttttccatagaattgccttgctcaggtattgaagaaggaaatctaattcgttttatagcaaaataaatgaagtcataatctggagtttctattaaaatattccaaaatgtatttatcttcttttactccaccttcacatatgcttgtgtacatctgctgacacaagtcatacctagccctaaactggctttacacacataaactaggaccccatggtctaagttcttcaattactttcacttacagaaattaaatcatgttcattttaacccagaacagcagagcgctcttccataaaatcagcagcaagttctgaattagccacaaaatctattaatgaataatagctatgtattaatagcttgagtctctacttttttattgttgttgactttctttttaccttctaaaggtctttttacattaccatgtaatcatccctactccgctattaactgccaacaaaaaatattataaaaatctgccttccagatttacattatgtgttatttatacataaataaagcaatctacattgcttttttttcactgagaataaaaatgaaataaatggctgccacaattccattcgactaggagaacattttgagtagtcaggtcattttcctatatcattctatgatctacataagcttcaacaactttttttgccatccacaaagaatatctcacccagcaagatctaatgctctgatgttctactaacggttccttctgagcttgtggttgaggagacatcccaacagcagttgctatcgataaaatctgattcagatggtcccgagaaaaatgcgtcccctgaactcgcttcctataaactcagccttttctcggagttctttaacctattcaggagagttcagacatcatatactttgtaaatgcttctttacaaacagcaccaagtagcatatcaaagacattgcacaaatacgccagggaccaaagacaaaggaaggcaaaattagccacatacagtcatcagactgtgcattaagcaaaaactaaaacaatcaagctaaagcatgatgcagttattttatttcagaccacaggcagggagaaattcatagcagctaagaaaaatattgacacctactttttattccaatgaaattacacaagtaatctatgattatagtttttaaaaactcaaaagcaaccaacctcgcataccacatggcatttagagaaccctagagaaggaatacagaaacacacttaatgatggttaatgccataattgaatattaatgggaatcaatgaaacacattattctcccttctaatatctaccaaacttgtcaatcaatatttcttgggatttttagtaattagttcagtaacaagataccttattattatcttgaaaaccagccacattcttgcatggctaggatgctgctatgacagataaattaggcaatctaactattattcctatttccctacctctggaagagtattacacgccaaaaatccctaacccagctttatttcatggctttgtatacagctactactctacagaagccctcactgggagatgaatgaggttatgaggcttccctctccaaattcctaatattcccttggaatcagcaaaatctcaacttttttttttttaaaaaagtactaaataataatttaaaataatagcccataaaatcataattgcaatgtgttcaacaaagggacaggtaaaaaagttctgctgaataataaagtgatatgaattatttaatatgcaagtaacatttctgatgaaaaaagcagccttcatacccatttgaaacctttcactttatacatcatactgcacctgctggcttctccaagtacaattccacaatgtaaaaaaaattaagttcaagttttcccttaaaattctgttcagtatctttatttaatctcaaaaaacactaattttttaaatctcaagacagaaaatctttattctagaattgcttttctttcagggcaaaaaaaaaagcaataatgaaacagcaatgtaaaagcaattgtagaaacatagctccttaacaaggtacgatttgaatgcaaagatgaaagtgttacatctctagggaattggccaaagcaaaagacagcactatatggcataagaaaccatataatcccaacagagtcctactctaatgaaccatacctgaaaaagttcctaaaggataatttgaaatattttcttcactgccaaaaaaaaagctatgtcatttatcatttctatcaactcctatacctttaaagaaaatttctagcagtggtttttgatttaacaggtagaagtgaggtacatgaattaactctactgaacttctaaccagggtatctgaatgcacaggaaccttgttataaagtgcctcgatatactccagattttattgccagaagtgcccccatgcttcaaatgtttcagggccactccatcacctacatgcctcagcatccttcctcctctgtgttctcagagttctttgggcacatccccattaatacatattcaatttactggaattaattgcacatgccctcctcctccatcaacctatgaacttcttgaggtgaggaaaacgcagcacttaagcactgagcccacaacctgtcctgagtgcagactaagtggttgcctgagctaaacatggcagccaaagataagcaagaaactccctgcactcagtgagccacctgtacataaattgtcataatattgatgggggtctatgccataataaacaaatgaaagaaatgtaagttgaaggagtagttcaaaagggggaccaatcagtcctgcactgtgttggtagattgacggggcagtgggggtggaagggacagcagaggcagctgcatctatccatgctgatgaatgaaaggatggatgaataccctccatgtacacagtcatccagttttatttgagtcaattttatttagaaaggagggggagagtatacttcataaaaattctgaagactttgtttattcagttctatttgttactgacatttaaaactaagtgctttaaatttactatatcacaatctttattaatctcagtgctaatattatattttacaaatatgattttaaatatcttagccctaaactaagatgaaaaattaaaaggctgacattttccaaagtagtatgttctataaaaagaggaggaaaaaaatcaatagcatgaactcaatgttaaatagaacaatccctaagccaactgccagagccaccaaaaaggatagaaataaaccattcccaactcaacaacatcacacacctttctgggccaagtaatgttatcatattatatattatgatacaattataagagaatgtttccttttctgaatttctttgtccaaattaagagttcaactaaattatttaaacatatgcagaaaattcaaactcaagaaactggggataaaaactccttttacccaaaaacatccccccaaaatgaggggtcactttatacctagtctttacaatgtctgtcaaattacggacatctctcaaatgcaggactttatcttgaaacacagtcctatttgtggaagacacatggaataaaatcacctcaaccaatcgatgatgaaaagattacctaacaattaagaaaaaagaagtttaacatagattaagtagttattctgaggatagaacctaaaaagttctaattgtgactattaagaaacaatcccttaagtgagcattttaaaaagcaatagtcaagtggttatataatggagatgacaaatacacaaccactgggcaaataaaaccaaccaccctaatgcttatgagaggtaactgggacttggcatagaatttccagtgactagactataaacagattcaaaagtatatctcaaacatagaaagaaataaagatgatatatggactcgaaaactaatggactcaaaaagtgagttaatattccaacaacaaagtcacttatgtctgagtgcatgtgagagtgtgaatacactccttcctgaaatgttaggagtgggaaaatgaaggagtactgtacttatatttaggaacctcataatcagatgcctatagtaaatgacttccaagagatataagaaaacatggctcatattaaatgtctataacctggtcaactaaaactgttatcatcaatgtcactgacttcttagctaaaaattcttattcttttccaacttcaatttactttttgaatatttttctcaaagaaattaaggcaaactataccactaatttaaatatttacaaccaccatatagtatttaataagcaaaaaaagctgcattaccaagatatcataataggaaaccttgaaagtctatcttaaattgacaacaacaatgttctcttccatcaaggcaggataaggaattcatcttactatgacttcagttttaacaatcttctcaattagatgtttagttctgatgctaaactcatcttagtttaaagaaatcgctgctcggccttttggctgagatcaagcgtagaatctcagagaaaacacagtcttcaaaacaaagagtttctcataacctcaacctagtgtacgcctaaacacaacaggccagcggctgacatcaatttaccagccacacatactgttctcctctgtcctgcttttcctcactcccactatcagactcctcagtcagggagatctttgcaagacttgggatggtcataaactgctcaagagtttagctgactcactgcctttcttccacacgggtgctttcgatgctcctagttttaacttgatttcactaaggtgaatatatgaacttgccccagataatatccgggacagctttgagctttgtcttttactttgcctgtgctgtttcaggccgtgctcaaatagagaagtagaaagaaagcaaaagagtggccacggtggaagaatcaagtgacctcctgaaacaatatgcagacagcatggcagtcgccaggacatatgtcgggagctgcagctcaaagaaccagcagctcagcgcacccgagcaccagccccttcccccgaggctgattatatataattgtgggccatggttttaagtaatgagctaaataaaagactattccccatccaaattatccttctgtttacaatgacagggggaagtgggatgtttactttgtctaaacagaaacattttaatttagcttgttctcacagaaaaggcaaaaaaaagtcagatatgatttgaaagatgctaattaatacaataacaaaaaggttccattctctatccttgagtataagaagctagtactaaagtagcaattctcaactctagaattacccttcccttcaacctatcttcagatccccagagtttctcccaagtcagagtaccccaaaactgtagctccacctctaacaacacaaacttcacctttcttttgcctacaaactgtaatagtacacattacaatgggcatcactatcagataaattatttcatcttgaaaattaatcttcagttgagaagtggaggtctggaggttatgaaataatcgaatctataatgatacaattctataaattgctattaacacaatcaaatgtttgatggtaaaaagcattaaacttaaaagacctcaataatattaatttctgaagagccagtggcattaaaaaaaatgataatttacattctaatacatagttcctgatactattagtgctattattatatcatacttctttaaattgtggtctctataccaaaaggaactcgttgtgaaattaaagtgttaacagaggctgaaagaacatgtaggctattgaggtcatgtacactcacctgatttggcatgtttccctttacatgtgtccaagcccagctttatataaatactgagctgggctcagaaattttgctctatattcggaattcacctcctaatagaaatgaaatgaaagtaaatatttcaccatgttaatcattgaaataccatatttcctattaaaatacatacccaagcctttgatgtttccaaggagtaagcttccttttagctggtgtaagtcttttaattccatctctgcttccaattttaaacgatcgtctattttatactctgaaatggaaatcatttaagctttttatgcttaagatgttacacattaaagtgaaacatgcatgttataaagttagacttgaatatttaatgacatttctatttttagaagcttagatactaaagaaaataaaaaccataagaaatcaacaaagaagttttgaaatttttagatatttggttagttatttttgaagtttagctgaggatatagtttcattttctaacaataagattttagatctttggctaaggaagaaaatttttaagttaacaaatacatatctaaatatgttaccacatactgaatttgatattctaaatttacaattgcgttacagtaattaaactaagatcctgatgaattagttaccaaatcgctttactgaataacaattctttttttctcaataatatcataggcctaatatatgtgtgtgtgtatacatcattttacttttagtcatattacttgtaattacatactttctatttttaggaccataaagtatcgggtatcaacattcaggagattcaaaaatagtatttataccccaattacctgtaatttataatcatgttagccgattctgcaaattaaatggctgtaatatcacacagaagcagttgtttgtatattctgagtaaatcatgtgaattatactggctataatttggcatgctaaagctttggtttaaaatactgtgatggccgggtgtggtggctcacgcctgtaatcccagcacttcaggaggccaaggtggcggatcacctgaggctagtagttcgagaccagcctggccaacacagtgaaacccgcactctactaaaaatacaaaaattagccgggcatggtggcgtgcatctgtagtcccagctatcaggaggctgaggcaggagaattgcttgaatccgggaggcagaggttgcagtgagccggatcgtgccactgcactccagcctgggcgacagaccaagactctgtctcgaaaaaaataataaaaataaaatacatataagtatgtatgtgtttaatttccataacttaaaataagtattctatcactactgttacccctggaggttactgtaaatccagtcatttgatattaaactacttgactttgatactaaacttattagacttacttcctgtattgttaagtactcatcatctgtatcatttttatttatgtctgtctccccactagcccaagagctgcttggggctattgccagccttgtattctcagtaccaacccatgtctgctcctagtagctggctcaatgaactttgatgaacaaatgaattaatgaactagtgaaaaccaaaaactcccaggtggtagtaataaacgaaaacgtggagaatctaaaataacggggattttgttttgtaaggttaaaagttatgaataccttcctttcaggagacactgtttcaagatttctgttttctctcaaatcattcttaattttggttctttcactggagataaacccttgaaatttcttttgtattcagtttctggatgactgagttacctttgaatggtggaacaaactggcttttattgtggaaaaccttaaacaaaaattattttagtttagttttgttgattaaatatgcggaactttggtcttcaatacttaacaaaacataaagttgaattacaggacaaaaaaatagcaaagttatatatgatttaatttcatttcacatatattattaacatccaaaggtcaactttatgtactcattacttgttttgaataacagttttgtaatcaaaatatagcttataatcaaaataaacgttggcaattttcatatgacatagacattagctttaaggcaactctgttgtcagttctacaggttttttcttcctccctgacatgattttttttcttcctgccttaatagaaaattcttcacattctgaatacccaatatgttcaatttgtttagcttttcttcccttggcttattttcagcgtttttattaaggcaaagaaaatgttctgagcaattactacacttctattgttaaatatttcttttatacttactacttcacaatatggtttctatttcacggcatattaccactgattaaaggaaagcaaatggaaaagatggggaactcagtcaagttatattactgctttgtaatgtggatagtacatcttcatacagatcacatctaaacagtttatcttttttagtacagtatacctcaaggactttactgccaaaaactgttctgactcctttacatattaatataagacacctttcagaaagcaggtgtctgataaaatgaaatgaacaacccttttagaggtttcctacaacaagcattgaaagctgtctcaaagctcttcaatccatagactctgaattcaatatgtttgaactaaccatgagcatttccttctaaaaaaagtatgtgaaacacttattaaagaagcagtaaaactactgaatatatcgctagtgatttctcttataaaagtaacgtttctacaaacgctttcactgacatgtaaaagccctatttgatgatgatagggctttgatttgaatcgctctattttaaaggtcaaatactctataaaaaactgaataattacaattttcaggttgaagtaatgttttaggtacacttaatctccaaaaaaacctgtaggcaagcaaaagaagtatgatcctatttactaggttaataaagggtatttatcactttgttacttcacagattcttaaatgttatataaatttcaaaggtattttaaaaattgaataataattaagcccaaagctccacaatttataggatcactggtgtttttctatcttaatgtaagatgactagatgttatgtcttgctgaatctaattatcctgtcagttcttacggctatacaaaatatacaagtgaagttgacgtacaggagaaaatgaatgtgagggtgtgtgaaagtgtgtgtatttataaagaaaacacgaagaccagaagaaaaaacagactaagccattacaggtctctggggatattccagtggaggtatttcctgtctatgcctagaagtactgttaagaacataaatgagagtttaagcctaagaactccctaaaggatgaaggtagtaaaacaacagactatctattagtaatgtatctcaatactaaaattgtgcaggagtataatgaaatctaataccacatcattacagctttgaattttacaaatatagttatactgacaatgcctattactatttgtctgatacaagacaaaattacgtatcttgtgttactgtcaacatattttgtatttattaaatattcaaagagttacgcctttcttagaatacaggaaacacgcaatatattagtcaacaaaacacaacatttagaataaaatcaatttaataattttttaataagtaaaaaaatcttgtagcatgcaaaacttaccagttccccaagttttcattaccctgtctcatatttagtatatgtgctgcattggcaacaatgatcatcagaagcctaggacagtataatattactaccataaatcataagaataggatgattttagcaaaactctcattttggttttctagaacctacctccaggctactaagtacttaatttctttcaactcttaattctatgtaaatctacattactagataagatatggtactcagaaatgtattacatccattaaactacctgattggctgcaaaagctggagagtttctttagaagtcttccaaacaaactgcctttgatattcagaatttctcaaggcatatatgaaggaacaacagtcaatccagctttcttacgcagaagtctatccaactgttcaaaaacaaaatccactcaaagacattaaaaatttctattcaaactttttaaaaattgtggtaaaaatgcataacatgaaatctatcctcttaacaaaatgttaaatctacagtgcaaaatgttaactacatgcgcattgtggtacagcaaactttcttcaacttataaatagtatctttttcaagtgtcaaactatttaaaattcctttctatcaaaggactattaggcatcccaggaaaatataatactctcagtcctttcctactaatcattcataattaaatctattaccaaaagtcccagcactttgcctcacctgcacactgcttctatgaacaccccttctcctgcctgcagactcacacatcaccttccttgttccctttcacccccagctttttcaacaagctacagttcttctccaacactctgaaatgcctcttcagggtcccagtcagtggtggacatgaaccgagaagagcagtggaacagaatggagaaagaaatgtggaaagcattgagatccccacacagttcctgcagcctctgcttatgtgctcacagggacctgctgcaggccagctgtgacatagagagcagaaatgcaagatctctgagagacagccagagctctccttccttttgcatttatcaattgaatttctgtttgtcttcttgtacacgataagaaactgaaaaggggctaggtgaagtcagctcagcaccctgccagaagtaagggcctacttcccttctctgtctcaacttatctctcccttaggactcaggtgctaatatatgatgaataaaatccagacgcaggaggtcatccaataaacagattatcatagtacaactactacaaaatagcgagtagtcagaatagactaattcacaataactaaagtcaacagcctgttatcaactattcttatagacattagaaagaaaacaacaatggaaaattctgaaacacaaaatgtaatattacagaaatgacaatgaaccaatgaagaattctatgcttttgaaaagaaatgcagtgaatatgcctaccccattactacattttctgaaagaaccttggtagaatgttccagttccacattttcattaactggttatggtttgttacaccctcattattttccacatctgaagccccttcagctctggagtctcagagtgagatctggttcttttgggaaccctggaagcttctagtgagtgaactctttctgagtaacatccttttgttctgcttcttgtgattttggtgtttccggggcttctggttctgtgatgcaaccacattgctctctgagatagctccattccactccagagattttgaaatcgtgggtcatggtaagggactcttctttttgaaataaaacttggctctttcgtgatgcctcaaaacacggtatacaaaaatagtagctactaaagcaaaaagttacaaagacaacttttagaacacttgtggaggagaaatgaaattttaaatttagttcagatatatgtacctatattacacacaatatccttcagattataggattttaaaagtacagcttttcaacataaaatattaattttgcttttaaaagcattaaaaatttgaccataacaaaaaattaaaaatcgggggtcacaaaatgttccagttatcctaacaaaagtcactagaattgcaacgtgatagacctgcaggccaggcagtacatgctgcctcgtttctaattactttcctgtgctacttaacagacaatgggccctggtactgtcaaaatttggaacttttcacaaagcttctcttatgtggagagaccaagatgagaagggatgagatgtcactgtgctggatcttggttctacatctgcctgatttcctgagaattaaaaaagaataagcccttttaacaacagctaagatacaatttcttatatttctgtatggaaagcaaatgtccaaaaacttaaccttctatgaaggtaagagcactctgcagaatgacagccactgagagactgccctagtttagggccattctttaagacagtgcagggtgcagaaggaagattaagaccagaatggaaagggaaggtggaaagaaaattggcatgaggtaaaacccagggctccttagcctctgttgtagatgtcttggccatgtcacccgggtccttatccttttaaaaggcttccctagaccacaggtcttctcactgggtggatactgtctggaggcacacaaagatgttttaggagggtaaacagaagtgggcagcttaagggatcattttccagatcctcaactccacatgtgctctcttgcctgatgctgatatatctgctgagagctgcatctgccatctgcagttccatttcccaccgcccctttcataatctccttttcccactttagagaagaaagacacacctcttaaccagcctgaaacttactccagtgcgccgcccaaggtagaacaaaacctcaggggtagggagccaaacaaagggacaattcaagaagcatatccctgagggagaatatttgacagcaaaacaaagcaggcagagattagaaatacaaagcaacagcatcttatttcatatagctccatggattttccatctaccttctcagtataaaattcagatatgagagggatgtcatgtgaaatgtacatatgcatataacacatttacttaattaaagataaacagactttctcacagaaaataattctaatttggccggttagttgccaatgaatactgactttgccaattgtatgataaacattttccaaaaattgaatgggcaaattggcagctccagagtttttacaaaatatatgtaaaatatataagcactatgcaattaccagaaattctatcattcaaaactattcataaaaatttattataaaaaatagcaattagaaatgtgtgacgaagcacaatgtttttctaaatttttctaggaagtataaaagcaaaaagcttgaagatcaccaattagactcctctctgctttaacacagaggcaggtttttggtgaagcacaaaatgaaagaagattctcaagtggtctgccgctgtctcccagcaccagcaatccccagggtaaaaatacactactctaaaagaagggacagccatcctcggtaacactgcgttgttttttgctaacctcccacctcccattctgagcattctggaattcttgctcagtcctccccatgacctaaaattccccactaacgttcctcccctagtccattccttccttcatatataccatgctctaaggtggctttgctctcatggtctcatttcatcaccttcccctcaatgcagctgatctaagctgaaatgttattggacaactacccagtttaatgaattttccatgtcataatagccctgtaggcgctcagcagggtgggatatctatgcttaaacagagattatttggattcttaatctaatggaggttcaaatatgtggaatttctggtcatttgtaaaagaggattatgagcagagggattttcctagcaccctgccggagaagcagggacacccagttctgaagtttgccgctgggtcagatcatgatgcttcagaggaactctaaaagagacactactcttgcccactcttccctttgttctctagaccaaattctgaaaatacctcgtcgtctactaactttccaggcttggtaccctacccataagtcttttcctggcttcaaacatctaaatttatgtgacttacatgccatgctcgcacacatcacatgtgggacactaagcactgattgtgtactcaaaccaggcccttaataggcaacatctcatttaaaccctcccagtaatccatgcaacagacttcctaaaatctcacttggtgaaactagctcaatttgcccaacatcaccagctattataattcaaatttaggctaattcattcattcaaaaaatagtttcaagaagcatagaatgttccaaggcctgtgttaggtactgggtggtgaataagacagagccctactccagagatctaatatactagtaaggaagaattaaataagcaggtataatgaggtcagtcttctcccttctgttctatcaccctccgggaaactctggcccaggactctgccttccctggacacagggaggaggcatgtgtgataacaagaacatgacctctgaaattacatgctttgccaaaacagacttgatttcaaatcatggttctgccacttactagctgtaaagctggggcacgacctcatctccctaagcttccatttctcaagaccttgggagcactcttccccagcatgtcccctcagctttcaggtctcagctcaaatatcacctcctcaaaaagagcctttcccaccatctaatctaaagcattttccctccaatccactcctcccgcatgttatgtatcacactccctacaattttatataaaaacctgaaattcccttaattattgagtgacttgcttacttttctctccacagttaagggactttggttcagggctatatccctagtgttcccagaccaactgagggtcaggctgctatttctctcggccaataacgagatgcagataaactagggagaagagagtttttatttctataaccagttacgggaagaaggcctgcaaattatcaccagagaaccccaaattacaaagtttttcagagcttatataccttctaagctatatgtctacgttaagtgtgcattcatctaaggatataagtgattaacttcttttaatctataactaaggttgagtcctgaagaccttcttctggagcatcagtaaatttacttaatctaaatgggtctagtgctgggctgattacccttatcttgtctcctgctgaatcatggaggtttgaggagttcttcagaccgccaataaatttgtggaggcctggggagtttcttcagacccccagtaaaactgtttaatcctaaacggatcctgttaagaattccttattttgtcatgctttatggcccagaaaggcctaggcaatactcttgatgggcttttgtgacatcccagcctttgtgtaagggactggctttttttagctttcaatatttaacttaaccgctcagtcagtaccgaaacagtttgatggaggcctccattagtgaaacctggcctgccacactagctgctgggaatagtcctgctcatagtaaaccttcaataaatacttgattaataaatgaataaatcaaccaggccaatgaacttttaatatatcatttggtaaacttagcccaaggtttacttagcccaagttatacggcttggcccaagttataaacttagcccaggttagaatggctattagcctgctcaactacctaattgatctgatctaagtccagcccatgggtactttcgccccacggaggaattacagactctgacaaataagactttttccacaggaagttcctctggtattcactcagccccttaatgcaaagtacacttttgagtacagtccaattaatgaatgatgttttaaagcagacacggtgaaaaataatttctgaacctcccaaaagagacttaagactgaaaattaaacacagcgagctccttaataagagctaatattcacccagccctgtgctaagcagttcacacgtgtatatcctttaatccacaacaccacttgaggcagatgctaccaggaattccaggctcagagttaccctttcactgattatctgattccaaagcatgagttcttgtcggataactaatgaaatctaaattctcatcattctagatttatcgcaggttttcaccgagtacacaatattattaccatgcctaggaccttttgctatttgataaagtcaacaaaaggcaaactccccttccttctgaatacacgcctttaagataaatgagtcaggagatgtgggacgctgtggccaccttgaagttgcagggtgctagtccctgacagctaccagctacctggaacttttaacatacgtaagaatgcacaacgatgaaaaacgtgtatttctttatacgctgtctttactaagaaccatttctcaagcctttaaaagccacatacactaaagttttaaaggtaatgggggttaaatctaagctaaatgggccacaggtgtcccaatctgaagtcgcctttagttctcttcgcaaaggacctcctcccatctccactcctcttgagtccccctaagtaaatgtgtctcgcaccattgactcttcgacacactgcagcttgcaaatgtgagtgagcggagagggaactaggttaaaggcggcgggcagattctggggcccctcgagcaggccctggggctggcagcttccgccggcagagggctgcagcgcagaaaagcagcgtgacctcggcgctccacacctccccggccaggctccccccagccacattccggcccggggaccccagcctcaccttgaagcgcaccggctgtcgcccggcgccggagcccccgctactccgacagttaactggagaaaaagctccgaggggcggggcgataacagtgttccctagcaaagcctcggcccggcgtccccgactacgcgcggcgcactccgcgcttcccgcctagaggcctgtcggtctgtttttccccgccctttttgagcctagggaccaatagagactcgcagagtgccttacctccattaggatttgaccaatagtggccgaaagggagccgcctacctcccttgccaaatccctggggctgatagagatgggggcggaaggccggccaataaggctcccggaaccgggctgggcgggaccccgggggtgcttcctgggttgggtggaccggtccctggttcgccgggtcctgcgcagcaatgcgtctgctgctggtggaattcgccagccgccagcctcgctggcccaggtgcttgacagcatcaaagtcaaagtgtgttcttcatgctaacatctatgagaaaaccgaacgcttctttttctgaaatgctcagatttattctgctgaatatcggttcgtacaaacgacagccgcattacagtttatgtcacatcaaaagggaaaggccaaaaaaatatataacttaggcaagatttttgaaacttattgaaactcgaaagacaaactgctgtctcttcctccagtgatgttcttcctccttcatctctaccttccccaaaatgatgtacatacagcccttagatgagaaaacgtttattgaaatggttgtctcaacttccaaaccttcagccttgtctctccgctcaacctttttttaaaataaaacttcatctgattttaatcgactattgccatcatcgtcgataaatgtttcttgacgaatactgctgattctgagaattgggaaagaaagaaattgtccagatagttctctgataacttgggaaggacatacatctttatttatttatttattcattatttattcaataatggttaatgtgacatgtgctaaatttctaaatgaaaggtgtcaataataagggctacaggatcgggagcagggagtcatttcggacggcagaagatgcgtcaggaggaaatattcagactgaaggactgcaataagtaaaaagtgggacgatgaaagggcagatgtctgaatggaatgctgcaggcttcttccaggaacaacaaatgagtgccttttacatttgtcatgtgttgactgaaaaaagtataccactcttaaactttcaaatatcaacaccaatccttgatgcttccctttagcattttccgcaaaagctgtcttcctgaatcctgattgatgtctttgttcttcatcatctcgagatacttaaaaatcatttgaagaagccacctgatatctggaacaaagagcatattaattagtcccaatgcagccatgcatccagggggcccttgattaatgttaattggtgatgcagcatctctgtcgtgtaaattaagaatggcacaaacaagacacagtggaacatagaacaaagtcatctgcaggaaggcagcccatcttacagagtaagaaaggcacaactttggttggcacacagctttgttaccacaaaatgctaaggtgagatcagcaaaagcaagtgtgtagatgtagcctgcctgctaaacaagcgcaatgatcactgcagaagagctctgctgagcaggggtaaatgacaggaaaaccaaacagcagattgtaaaaataactcagtcacatcccaggctgctagagaagtatcataaagacttaaggaagaagattttactttgctattgttaaacaaagcctacccaagtttaagaggcaaagatataggaatgggaaaaaaaaaagtgactacctagtaaatgagttttgtagcctgtgttttaccagctcttatcttctctgctactgcaggaacagtacccagtaccctacaaagctccacccatgttttggggagtccctaggaggtattcacatgtgctcgcagcaaccacatagcgtatgccgggcagcactgccccttgttccaatgccatgcatctgtaggtgtcactcttgctgctggctatcacagccactttagcttggtatgagtcttcactgggcacagcaactgggtacagccactcctcaaactgcctggcattggggtaatctatggcaaagcacctctcctttttgcgttaccctctttgaagtgagtaacacatgtcttagagagccttcttttcatttgtgttttagcctttctcatcgccaaagggctcaaatgaagtccgtggagtctaagccaaaaagtaattcctcaagtgacagatctcatgcttgcttctctcttccactagctaaggccctcttactgggacagtggtatcacacctggctactcttccctttgttgatttctctatttctcataggaatagatttctgtctattgctcggagagactgaatttgcacaacctatatgaagggcattttggcaatttgatccaggagttctcttctataaatttatcttacagatagactcacacatatgtgaaaaaaaatattcattaaagttgtttaatgtactgtttctagttacaaaaggttgaaaactacctaaatgtccattagagagaactagtcaaatacattacggttcatccaaattcaaagagtagcgcaggttgtctgctcctttgggccttctgatcctgcatggatatgttaggtccagctaggaaaacagccctacacaaggcatttcaacaaagagaacttaatataagctattggttcattagctatgaagaacttaaagccaaaaggataaagaagaggaactccaggaagcagctcatactgtaggctgagagaacaaaaggaaaatgttgaggttactagaatgcggaggtttgtaggagagcctcctggagttggtcagaccgctgagaaagggccactgccccactggtggggtgcctcgaggggacaaaatgagactctctgggaacgtctggaaaagagacaagctggagactgcatgaactgccactgtggggtagaagatcactgttcaggtgctgcggggaggaacagcaaaaaaacagagcatcccagtctttccctagcttcctttcttggcaaacataacagggagctgccatgtgatttgcacagtctgaagggtgagactggaactgacatgcaacagcttattacttgcacacttccatacaacccctaacaagcaagaagcacctctttatgagctaacataaagactctcaaagaaaagaagcaaggcttagaagactgtttatggtataccatcagttgaataaaagaaagacgagtgaataaaagaaaaaaaaaactgtcctatgatgtcgcataatatgtcattcacaggcactttctccctcactcatgagtccaactccattagcggcagctaaaagaaaagagcattttattcagtttactggtaagatatggaaactttaagttattgatgttaccactgaggctattttccttaaataaaataactccattggccctttctagatttacttgacatatacctcacgataaggctgttgctccttttagagacaaaaacatatcaaaacctttgaggcaaattttatttgcacttgaaatataaaatattctcatctactactcatttattaaaaaaggaagttgaccacttcacaaattaataatctcctatcattttctcagtacagttgaaacagtgaagaatttgtatttgcctctaactatatttatttttatttaacaaagaaaagtgtatatgagcaaacacatcagacgagggttgaagaagggaggtacaaagataataagacatagcccctgtcttcaaatataattataatcttctaatgggggatcaataatacacaaagaacacagaaaataaaaagaaaggagaaagtgagaaaggggctaaatgtgacaccttggtattctaaagatgcttttaaacctggagccagaaagtttgatctaagatagctattaaagagcaggcaggataaaggagctgaatttaaattccatcctgggaaacacctatctagagacctttcactttttttgttctgccctgggtagctgaatccaagccagatgtccttgagaagtttcaactaacattgctgaagatcggttcccaaaaaggtgaattacttgtttctgttgtctttttttttcttgttgcttcggaaatcagtaaagctgttttagaaactctattttatcaatatagtgatacacagccttgtgtttacatatatgtaattttctctgaataccttacaaggtaactgaaatgccagtctttgggcttagtaatgctctttagctctgtaacattctctcaggtcacatttaattgggctttcattggtaaatcttgagctcagccttgccaaaaagcaatcagtctgacaaccgctttcttttgcatttttccataggtattagcgatttttcctcctatgaatgaatttctgattgcacaactaaaaaaaatgacaattaaatcatggattctgtctgagaagcaaaattgctgatacttcacattaatgtcagtaagaatcaataaataggttctatgattaagacttagcaatgagccaagtgcaatttgccctccagattttagccgtgagatgcctttgttgacaagggagtgtctggcttttgaatcagtggggcccttttggagggactccaggttctcttgacaacaggactttttttttttctctctttttgtgagccgaaaggactcctcaccatacaaggccacggctgagtaaagtaattctcagtaggcataaaccactggcaagcctcacataccataataataatgttgtactgcagctgcacaggtccagggaatacatttggggcacaaaatttctttcattttaataccttcactgtatattctgttctaagaattccctttccttttcttcattgattatttattgtcctaaatcacatctctttgaaaagtcctcacagggacgcagatattttccagaattgctaattgctgattgaaagcatgaattctctcatctcatcaaatcggattctgtgtcttaaggtcagatcagctttctaagaatcttgtaaatctctacctttatgccaaaataaattttgaaatatttctttatcacgggtaatgtacatgcacctgtaatcccagcactttgggaggctgaggcgggcgatcatgaggtcaggagtttgagaccagcctggccaatttggtgaaaccccttctgtacaaaaatacaaaaattagccgggcatggtggcacacgcctgtaagtttcagctactcgggggctgaggcagaagaaccgcttgaacccaggaggcagagattgcagtgtgccgagattgaccactgtactccagcctgggtgacagagcgagactccatctcgaataaataaataaataataaaataactgcagattaagtccagattgctactattattctttctgaaatcgccagctttctactgataatggtatctgaagtatcaataagggaccaaaaatttttcagaacataagtcagtttcctctcctttgtggcttataattgttgactcccttaagagatttttatccttaaggcctggcacggtggctcatgcctgtcatcccagcactttgggaggccaaagcagcggatcacaaggtcaggagttcgagaccagcctggccaacaagatgaaaccccgtctcactaaaaatacaaaaattttccgggtgtggtggcgcacacccataatcccagctactcagaggctgaggcaggagaattgcttaaacccgggaggtggagattgcagtgagctgagatgcaccactgcactccagcctgggcaacagagcgagactccatctcaaaaaaaaaaaaagtttttacatgtatttt

SEQ ID NO: 5004 - DNA, 100000 bp, Homo sapiens
attattataacatactcatacccatagttaaccagcactgattcccatcagattgactagtgtctaatgttctttttttttgagatggagtctcgctctgtcaccaggctggagtgcatggcgccatctcagctcactgcaacctctgcctcccgggttcaagtgattctcctgcctagcctcccgagtagctgggattacaggcacccgccaccatgcccagctaatttttgtattttagtagagacggggtttcaccatattagccaggctggtatcaaaccctttccctcagtgatccacccgcctcagactaccaaagtgttgggattacaggcatgagccaccgtgcccgccaggtgtctaatgttctaatggctccctctgagagtacaagctgattccggagaagactgtatttgaatgcaaagggtaaaataattccaaggtgcaggggaagtggagagggctgtatttcctctcacctccaggaaggggaggccgcaatgggcacacaggcagatgagaaagagtgaaagcagcagagagggtgggatgccaggagtcagtcaagcctacttagaagtattggtcctagggctattccaaaaaatgtctcagaattgtttcctgctttaaatctatgattcccctggttttatgagtcagcaaagacggaaaacaactaaaaggccatgttaatatttctaatcactaaacacacctacctcattaaatcttgggtcttacatattttcacccagcatttgttggtacttgataaatatttgctgaatgaatgaatccttccatgattctgggtcctccttatacttcagaggtgactcagtattggacacactgaaattttaatgcttgatgtagcttccataaaatagcagtgtttttaaaggtctagaccaaggtgtccagtggaactctgtatgacgaaaatgttctttgatctgctgcgatcaatacaattgtcactagccacacatggcactgaaactcggaatgcagctggtgagactcaggaagtgccttttaatttagtttaacggaagtagccacagggggcaagtggctgcccactacattagcacagctctagaggttctttaaaagttttctgcccatctcactttgaaaaccagctattttgactaatatcatcaatgttattcataagttcctgtcatttgtgatttttatcttttttaagtaatttggtttattattacaactttaaagtgagtatagcaaaccaaatggacttcagcgagaagcctctcgggtgaatttattgtgaatcattttgaggacttgcaatatgtggtcaatttctaatttcaacattgacacaaaaggagagagcctgtgtagttgaaacagggaagcaggagaagtccgctggcactgacagactggcctctcaagccagcctcctccctccttaggaatctggcaccctcagctgccctcggggtctgcaggagctctaaaatcccttcctatatccctccgtgtcctactccctggatcctctcctcccttccaaatcaaaatgtaccttgagggagaggcttgggcggaggatctcttgagcccaggagacctgacttgagtctggagacctgcctggcagaatcccaatcagtggtgatgatgctgattttatggattaaaaactgagacactgccaagaagtagggaagggagcgggggagggcaggaaaactaatattgtttaagtacctactatgtgcggctagacacttcatatgatgctcagtaaaaatgctttgcctgcatgaataactgttatcccctggcaagtagagtgcagtatgttttttttttgaatggataaacacatgaatacattttaccacatgaagcagatattagtcccatatcacagatgaggacactgacatttagacagttatgacttcaaggctaaacacacacaacattccaatcacctaatcttgttctctcctactgtttagctccctgcccagtttcctctgtgctcagaattttgctcttgacctttgtaaagaacgaccagctaaactgatcaacatatttataccaacggatgcaaatatgatagaacgcccccagcccccttttgcaaggatcttgaatgttaatgacaatcttctggggacaattcaactcacagaaatggctccctcggaatttcacgctgttcggggaggtattttggtacttagtggcattaaaaatatattccacagcagatattttcctggaggctggacacttacaaaagacgacgcattctttataaattaaacctcaacagtgtttgcatttatctaaatggaattatttcgaggaggagacagtgatttgcgtattagcccctatcactagggatgacttgaagacacattaggaactggctcctcccctatcccttcgccccctcctctcagaaccttaaagcttcagagtacggtcaagacaagaggagcattgggaaagaatttgaaaataaaaatcagctccgtgattttcaacacaaagaccacgaagagcataataataagtcgtgaaaaaaattcacatccagaagttggagggccacaaagtacaagtcgtccaggccagtctgcagagctgttcatgcttccgcccagcaaaaatctggcaggcgacacatcgcgacgaatttcggcgcagaagaggaagagcatcacctgcagtccgcggcgtgggaaacgccgccggaggggctcgcgagccggggaagtgcgcgcagcggggctccaggcggctccaggcgctgagtgcgagaacgcccgcgctcgccggcgcccgggagacgcagccgaaggaggagggcgggcgtttcaccgcgccacagctgcggccggccagagagaccgcagaggccgggacccccgcagcctcccggccgctgctgccactgtcggggtggcgcgcccagccggagaatcccgtccgcgcccgggcggggggcgaggcggggcgctgacgtcacctcccctcccccaccgcctccaaggggggggagtggggaaagaggcagcgagtcgccgcagccggcggccgcaactcctcaactcggggctggctgcctgggcacgtcctgacaaacttggctgctcccgggccctcgttccggcccgcgcactctcttttcgcctgcgtttggtgcttaagtttgccctggtcggaagcctccgagatgcggccgcctgggtcccggcggcacggacgttggcactctggttagggacatgctaagatcccggggaggcaaagttggtacttcaaacccggctcttaacacatatctacacccgaggggatcacggagctgccgaggactttagagcccagggccgaggactcggctagacggtgagttctttgttcaaatcgtgcatgccttttggcatttaagtttaaacgttaatgaattacgtggggtgtgtggctctaagcgagtgcggggaagcgtgtgcgccctacgggttccggctccaggagctgcgcatccctctggctttgtgcggatcggcgatgaaagattcgtagcatagctttgggagttcataaaatacatatagagcactgttaaaaagaacttgagagggatgctgtttgtgcattattttgaatgtaacttattatagcaatggtgcctagggaggggcatcggggccgcgagatttgcaggggcgcagcgccctctagtccgggcacctggcgagcgcgctccttgcagggttctgtgcggaggcgaacctggacctccccggcgctcggcgactgggcgcttgctcaccccagtcttcactgaccacccacccgggcccattctttatatgattacaaaaatcagcttgggtggactggatgtagaggccgtgctggaggaaagcgttttgttctggaaccgtctccccaaccccctccctaatttccacgagcctttggggacagggttgggagggtcgattatttaaaggacaaatgtggaacttgaaccacatttctctctctcattaaaataattcgatttgtggtagctaataggcatgtccatttcgttctgttggcgcttaggatcagtagaatcgtggcagagtcctaagtctgaaatctccatccctggctctcggcgctcctgtggcgacgaagtgcaacttcttccaggcagatagatttctcagggagcctggaaatcgggattcccagacagatgtaaaacatctagtaagccctaggaagcgttattacttttaattaatggtaatcttctccaggaattctcttgtgccatttaaaaaaaatcccgtgatttacgtcagggaatggtatctttgtactttttttactgttcttcttttccccttttagattactcccgcttcctcgctcccaggaaacggctggagttccggtgtgtttgggttttgtgagatttacaattcggcaagcggcacaagccggttgggcttggagatcaggtcacccatttcgaggtgttccatgtatgaaattgacctgtaagcacttggagcaattatggccgggcaaacacgtctttggatgatggagtttgcatttgctggatgtgtgaatctatgtgtattcaactggtgggcagggaatatagggctacgaatcggcacactcatcttgcaggcattattttccttcccagccacaacctgctagacacctttattattattattttttccggtcaccctaagatggcttataaggtgactgcgttaactttgaacccaggaaattctctttcacactgactgccctgccgttcccctccccgccaagctcccctcaccagtcccagggaaatcggtctctttgtcttcccagtgttaaaatgcctgagtcccacaaactttccgagatcaagtcgccctcttgtccgggctgcgtcccagcgcctccggccctccgggcttcggccgagtccgcctgcgccgagcctgcggctggagccctgcccgcaccggggatgggctccgcgcccgggcgctcaggctgggcgcccggcgcggggagttctcggagcgggcttctcggcgctggggctcccctctgcctaggaacttgcagttgtcggcctggggtcacgctttggggcccctgggccgactcccgggctaggaagcccgcgggacgccgcgactgccttttgtcccacaggcctggcgtccggggtgtcagcgggggaggccaggcgcccgcggcggggagggcctggggtctactcggcagaaaaaggtcgcgggggaagcgtttccattttctggggattgaaggaggaatagattccgacctagctgcattcctttggagacctgaaggacgacttcagcccaccaaacttcgcggacccagagccgcgccattcaaatgcagattcaggggctcccagaaggctatgaaaagctaaagggatgcctctgggaagctttctcattaggccccagcctttttttttttttttttttttagctaagctaacgtttccctttcttggcagggagctttccccaattcctgcacagcgcctgtggctggccgtaactaacctcggcatcacaagcctcgccctgcccccggagccgcgctagaccccgctgggcgccttctcgtctcccagcacggacctggtgttccagggactggggctctttgggtccgggcgggactgcgtggccgagcccgcggtcccagaccggcagccggggaaagtgggctcgagtttccgcgcccgagaaatgagcgccggcgccgcgggcggggccggggcggagggatctcctgcgctcggggagcgtgaggcgccggcgccggctgggcggccgggcgcggggagagggcgcgggagcggctcgtgcggcaggtaccatgcgacgcgcgagcccggcgagggccccggcaggcccggtccctgctcgggggcgcgctgagcggcgggtgagctccacgagagcgccgtcgccacttcgggccaactttgcggttagttcctggggcgcgggccggcgggcgggggcgagagcgtgcagcgcgctgcggtgcggactcttgggtgtccgcccggtccccggctcgggctccggcgctgccgaaaacggatgagcgcgcacttcccggagggtggagtgactcggtccttcccagttgggaaattcagcactggctagggggtcccggcggcggagcgggaaaaggaggcgaccgcgcgggaccgatccggggccatgctggggtccgatcctttctgacacgccgccttccctccgggagctcgccgggctgcgcggcctcgcggtctcctggggcatcccgccgtctgcgaaagacccgctcgctgagcggtgacgcgggaggcctgcgcggggctgccgggtccctgggtctctgggtgtttgcgccctgcggagcgctgcccggaggtgcagatgcaaccggtggactgcggagtgaagggctgcgaggtgcatttcggggctgaacatctgcacaatgtgcggtttgtcagtgttttctgtcttctcggaggaggaacttctaagatctttttaaaagaaagagtttttggtccttcattgcctttaaaaaaaatgctttcttttagagagccagctttctgctgtgtgttagatttttttgttccgctgatgtgaattgcaaggctttggaaacaaggacgcaattgtatgagttaggaaagtaactcataaatattttctatgcagttaagtttttttttttgtctgaactgtggtttcataagtggcttttgttaagcaattcccgggtgcctgatagaggcgattttttaaaagtggaattaacagtgattattagtatgagaaaagattgaaaagaaaatgaccttcagatattcattccttttcaaaagcagattcttaatgcttcgtatattcagatacaggtttcgatagttaagaaggtatctgtgtgtgagaactaggtaatggtgatgtttttcacactattcttaatagtttggttatgctgtccaacacatccagttgttacagggacgtttgaaaaggtgtttcccagttaatagttaattgtgatatttgtctttgtctttttgtcttaggaagacagctctattccacagttagaattattcctttgtatttaagatgtaaaaatacttaaagcactatgaattttttaaaacaacaattggtataagccttgagtgatgctaaacatggcatttaacagctcaaggtaaggtttgatttgaatgaagtttgcatttgtataaccattttttgaaaaagaacaccttaaatgagccaaattctttggcactctggaaagaagtgtggttgttagaggctttataaaatcatttcgggccacctgtatattcatttgtctcttttgaagtatccccgtgggttctcatcatgttagtagatcatttaaatccatggtccggacaggtgccaacagaaaatgtttaaaaattatggccgggcgtagtgcctcacgcctgtaaacccagccctatggaggtcgaggcgggcggatcaccggaggtcgggggtccgagaccaacctgaccaacatgggaaaccccgtctctactaaaaatacaaaattagcggagtgtggtggtgcatgcctgtaacccagctacttgggaggctgaggcaggagaatcgcttcaacccgggaggcggaggttgtgtaagccgagatcgtgccattgcaattcagcctggggaaaaaaaagaaaagaaaaagaaagaagaaaaatctttaaaaattatgcacaaactaattctgttttcattcccctgatcatctctacctttccattgcctttagactttgctttgaggtccctttgaagcagtcgtttcttgaatgttagaggtggataggatcttagagattatgttttaacactttacccgcttgcttccacccaagtttggctgattttacgtagaatcaatcagccaaatcaaattagtacattttattgcattagattctgtctcagtggcataatttgtagcctaaaggacctgatttaatgcagggagccgtaaggctggatgtgctgtttaatctttatgagtgggatttgcgctagaaattgttcttttgaccaaattatgtagaagttgaagccaaactctatcttttggtctcattaattgttcagtttgcaagtgcttatttatccttagacactggagaagagtttttgaatgagtgatatacatcagttaagatcaggaagttgccattttctcatacctgaggggaactttcatttcaaaaatatattctgatgaggaatctgcatatttcactcttttaagtttttaagtcatcttttactgtaagtcccagatttaaatacattgcctgaattcttgcttaattcaagggttcattatgtatgtgaagataagtctataaagtaaaaataataaaggcttctaacactgcttaggaaatattagtcatgatttaatctgtatccttcatagaatattaaggtagagctttgtgataatctgcaacacagacactgatctggcattatctatagccaattttaggcagcgtaaggtgggtggtgacctctttctgagctattggaaatgagtcctctacaggcagccacctgcagtgttgttaccagcctcgtggttgtgcctggattttctgttaatttagaaggatggatgttttattttcctatgttatccctctctatatcccctccccaacacatcctgcctcacatttctcactcttaacgctttattcatctgtccatttaccaatccaacatagtggacctcctctgtgtcaaacattgggccagacacaacatctagtgctgaacaaacgtgtttcctgccctcaagcagctcgtagtctgataagggagaggacaagtacacagtccttatagaccagtgtgataagagatccattcaggtcaaggtggtccatagcagcacctcgtgagctgggggatctggggcaggtggatttaggataatgtgagttctgagggaagtgtaatcagaggggaacaattcaagcagaggaaatgatgtgtgcaaagcaagttatagaaagatagtgtggcttgtggtgtgatgagtggagagaaattctgaagacctcaccgtaccatgtatcttaggaaaaggattggcttcttttttttgtctaggtagaacatagagaatcttgatatgacttaaataatcttattaaaaaagggaggattgtttttatgaggcagaggttaagagagagaaaaagaaagaaacgttgaagagaaaggtgaaaacaaataagctgtatgtgagagtggagggcaggaaacaaagaaaatagtaatgtttgcattatctttcggaagggaagagtcaagatgttacattactttagagccttcaccactaggtggtgttattggctcaagacgcttggttactgaacttgttgcaagtctgggaagtatgcctttttgttttgaaataagagtagtgttgggaaattaggaaattagttagaggttagattatcaaaggtctttaatgcaggttaagaatcatatacttagcaggctaaggggaaatactgaatattttcaagctaaagataatatcacaaagaagtttgaataggttgactgggattgggggcagaaagcaggaatacaaaagactgtaggaatactctgcatgaacaaaatacccattctaactaggtggtagcacagaaatgcaaagggaaccattttgagaaattgagaaagaaatgtcaagtttggataactttgagaaatgaaggtttgagagccaggaggctgtaaagattttagtccatccttcaattctcgaatacatagagtcgaaaggattaagcaagttccttgaattcacacagttgattatgacaaagctggagctaggttccacatttgatgttctcccaaccccttcctttttgtttatttgttagtttgcaaacttggttgatttgggaagtggtgagattggaaaataactggagagctgttattttgcaatggcgaaagggtgaaaagtctatatagttgtcccttggtctcaagggaggtttgggattttatacccaaatctgagaatgctcaagtccctgatataaaatgggtactatttatatttttactgttttattgtttattttaaagacgttctcaacctgagttggttggatccatggatgcagaactcttatatagtgaaggccaatcgtataacttaggttgatggtattttaggaggaatgttacgaggtgtttgagagaggttagagctgaaattgagatttggtgcactgatccttcatgatttgaggcagagtagatgagatctttaagggtgtaataaatgcatgtggaggaagagttggaagacaagtttgtaatgccagagttgtaggtagtcagtgtagagtataaaagagtatggaagagaatcaggagaatgttgtcattcattttcatacctgtggattgcctctttgttttgggggactctgtgaccgaatgaaggatcagggtgttggggaggggagtgagtggtgtcaaaggtgtcatgaaatcaaggaggatgagcacgagaaaaggtcattggtttgacattagcttgtgatgcgggaacggctgttctgccagggggacctgcaggatctctgtggagcagcgtttggcggagagggagttctaaggaagccaggcggtgctgtgaaactccttttcttgcgatctttgccagtataaaaaaagagaagaatagagtgtttgtttgaaagaagcaaaggtttgaatgaagtttattttattttattttatttatttttttgagacggagtctggctctgtcgcccaggctggagtgcagtggcgcaatctcgctcactgcaagctccgcctcccgggttcaagcgattctcctgcttcagcctcctgagtgctgggactacaggtgcatgccaccacgcccggctaatttttgtatttttagtagagacgggtttcaccatgttggccaggatggtctcaatctcttgacctcatgatctgcccacctagcctcccaaagtactgggattacaggcatgagccaccgtgtctggccaagcttatttttaagtaggagaagaacctgtgtgtgtgtatggattctgcacaaggtgtcaggagtgggagagctgtagaagaggcaggattttgtggtatcagagtatctttatttgcagctagggtggtggcatctcttctgaggtgtaagaagagagaacaggtgaagagaacattttaagaggagagggaagatggacttttctccctgaagatttccgttttcttgctgtacatggaacattactttcctggtctgtcatttagtgaagggttgaccgaatctaattatacagggagcccattcaacgtataaaataaagtcttacttaccaacttgggagtggaagaagtggccattgtgattattggctactctgccaagatgtcatttaaattacttctgtttgtggagaaaaataattagatgagatgatctccattcacaagaggtcaacagtccattgagcttctccttgggaaagtttgtcctggaatgtggatgaggagaaagtggttggaggataaggaatatatagaaggggaaagaagagaatagcacaggaatgcctcaccctgccagaaatagacacacagccctgcctacctgtcctgtcttgtcgttcccaggagcacagaacaactagaacccgtcatctcgtaatgccaacagacatgttttataggttcatgtagataactaggttttatatagagctgtttgaaaaataggacatctgtttatctttcttaagggcaggaacacttcaggaatcattttggattgattaaatcatgtacatggtgaagttttctgaaaaagccagattgtagtccacactgtcattgtcagtaaagaccattctcagggttaaattggaaccggtggttgatatgtgaaggcaatatttaaagtatgtcttgctagagttaccagattattgcagccccagcaaagataacaacatataaatggagttagcagaagtgattaaatgacatataccaagccaaggctgctgctcaatttctagggtcacagcttcctccgttcatgctgaaaatcatatgagatgggttgaaaagaattagtgtacacccagaaaataaacaggatctactcattagtattcagtgtaaggatgaaagcttttaaaagtaccgacatggctatgataattgaactagaaaatagagagttttttttttcctgttgtaaattttatttggaatgtctgaaattttagaatcattcaacattctttttaatatacagtatttttaaaaagccatttacgctgggtgcgtggctcatgcctgtaatcccagcactttgggaggctgaggtgggtggatgacttgcagcaggaattcgagattagcctggccgtctctactaaaatacaaaagttagctggtcatggtgtgcatgcctgtattcctagctactcaggaggctgaggcatgagaatcgcttgaacccaaaggcagaggttgcagtgagccacgattgcaccgctgtgctccagtctaggtgacagaaaagactgtctccaaaacaaacaaacaaacaaaaaaactcgtttacaattcataatctctgacaacttcatgatcctgctttgaaaatgtgtttgccggccaggcccagtggctcacaatgtaatcccaacattttgggaggtccaggcaggtcgatcagttgagctcaggagttcgaaccagcctgggcaacatggtgaaaccccatctctacaaaaatacaaaaaattagctgggatggtggtacgcccaggtaccccggaggcggaggcgggaggatcacttgagcctggaagttggtgctgcagtgagctatgatggtgccactgctctccagcctgggagatagagcaagccctgtctcgggggaagaaagatgcttgcaatttagagatctcttaaaaatactttaaaatgtgacactgaactgaactcgaaattccaaattttaatcatgagttaaattctactgagctttcactatgttgatagaaaatgagagtggagaagagcacagtgagggagaacacaggttctcaacttaataattttgtgtttttatcataacatgtgaaatgaaaagtttaataagtcctgttccataaaggctagaatgactacttgtgcttgtaagaattgtgaccgctcagaataaatatgcggcgtttaacagaattggtgcattgtgtgatgctgtgtctcacctaattcctgtctctgtggcgtgtgaaacccttcgaagacttgagcttgaggtcatctaaacactgaatatatgcagttaggttttcagcacaggggctgtgttctgttttgtgaagaatgtgagtcacagtaattgatggaagcattttacatgaaggtctccctaatgaagaaatatgaaatattaatatctgatttttactgcaaaagttatttttctgccgtatttatagattttcaagatctatgctaaagatatttaagctttagactgggagcccttctccttcaaggctagataagtaaacactctttgttttggcttcggaaaatgcattttagaaatcccaaattgcaggagtttaagtagtgtgatcaccttctaaatatcaaagtatagcccttggctcagatggttttggagtttaatttccataagcaaaggagtctaggcgataaggtcctttttagatgaatggtgttggagtctctccccgcttcagctttactgtttgttttgcatgagagccacagcattgttttgatcagggtggtttttatagtgaaacctgaattcgtggttcttggttacatactgcacggttaacaatgtcttccaaaaagtgtattttttcatttaataatttattctatcacagtagcattctgttagccaagtttgcagagtacattcaggtttttcaaagatttcgttaggaatgtggtccacaagtccgtcccagctgtattgtgtcccgtgagaactgctgataggatgtggaaggtaattgcatgtttgggaatccagttggggatgagtgggtggtggtggggctgtggtgggactgagcacctgggacagcatggggagagaacagccaaagcagtcgacgtgttggccatggtctgtgtgtcttaggggatggaacagtgccagagccttctggtgggggatggagggggaagcagcgtggcgcatcagcaagtacttttttttttgtttttgaacagagtcttgctctgtcacctaggctggagtgcagtggtgcgatctcagctcagtgcacctccgtctcccttgttcacgcgattctcctgcctctgcctcccaagtagctgggactaaggcgcacaccaccgcacccagctactttttgtatttttagtagagacagggtttcacctgttggccaggatggtctcggtctcttgacctcgtgatccgcctgcctcggcctcccgagtgctgggattacaggcgtgagccaccgcgcccagctggattagtgagtatttatattaatagaactccaagttctaatgttaggcttcagctgtagaaaaatctttatttactcacttttcttatcacaccactatgctgtggttccctttcctccctcagtggccgacatctccctgtcagggcctcccgtttggacccttcaaatcttggggttctgctcttggatttttttttcttctgcctgctctcttccttggtgatctcattcagttctgtggttttaaataccgtcttcatatttagacaactctcaaatttctatctgccggctggagtctcccacatatctgcgcccactcacaatctttacttggatagcccgtagctgttcccatcttaccctgtccaaactgacctcccgatctgctccctgaggctgcttctcctcctgtctccctctcggttcctgcccccttgttctctacgctgagcagtctttggcatcttctctggtactgttctctcctctttccctccctctccccactccagtgcatcaggcaaccttgaaatagattcacaatctgcccccacccccgttgtgccccagcccacacgcgctccgcctgtgttgtggctgcagccttgactgctctggtcgccctccagcttctgccctggctgcccacaggtttttccattttatgagaccgtggcactcctcggttcagaatccgctgggggacttctcatttgattcatacaaactctaaagtcctaaaaattgtcctttatccatgagtccagacggatcttgagaaaaaaaagattcaggttggatgcagtggctcacacctgtaatcctagcagttcgggaggccggttgggcagatcgcttgagcctgggtgtttgagaccagcctgggcaacgtggtgaaacccgtctctataaaaaatacaaacatgagccaggcgtgctggtggttcctgagtatgtaaattctgtcagtctaaatctacagacgcacctatagtcccagctactcaggaggctgagacggggcccggaaagctcaaagcttcagtgagccgtgatcgcgccactgcactccagcctggtgagagagcgagactctgtctaaaaaagaaaaaaaattgaataaataaatggaggaagtagacaaatcagtttctagaagaattataaatattttgagtagcgaaactctctgtctctaagaatgggctacatgcagtgacttccttaccaagaatacagtacagggaggggtgaagtaacctgactgtgaggaaacctggcagatactacctcagtcacgtggtcaggagcagctcaacatcgataaatcgtgttgattttacccgcttgctacggtgtggtggaaacgactcacctctgtggcttttctccccaaaacagaaccccaatctaatcaggagagaaacgtcagttccagttgagggacatcctacaaaatacctgactagtacttctggaaactgtccagatattaaaagcaaggaaaatctgagaaacgtacattccagaggagccttaggagacatgacgctaaatgtaaggtggtgtcttggaagggattctaggatggagagaaggccttgggtaaatgagcaaatttgagtgaagtatggactgtagttgatgatgtgtcagtactggtttgttgttgtatctagtataatgtactaaagtgagatgttaacagtaggggaagctctctttgcacttttctgtaagtctaaaagcattctaaaataaggtttatttttaaaaagaaccccctcatgataggttctctcccaggatgtgccccggccttaccgctgtccctcaaccgctgtgtccagccacgtggtctctttctggcttccctaatctagtgcttctctgcggggtgtgacttctgccctagagggtgtttggcaatgtctcgagatagaggtatttttagtcatcacagtgggtgatgagggggatgccacaggcttcatgctggtggggaccaggaatcatattgaaactctacgtttccccaaagaatctaagagttgcccagcatgtcactagtgtaagccctgccctttggatttagggttccctcttttccttcaggttcctgaccctggtctctctttgcctgctttagttttctccttagcacttaattatcagcatcggatatactctgtttacttgctgtctgtgtctggccaggaaatgtatcttccatcaggacttgttggtaatttggttcattttgaatccccagcgtctagaactgcacctgatacatagtagatgctcattaaacctagtaaaaggaattaaataattaatgaaaggggtgagtggatgataaagacaacacatactatgctaaaaaaaaaccacagtagagaaaaatgccacagtaatcattccctcagctaccttttctctaccggttctccagaagttaccactgttaacagttgcttgtctgcctagactttctgtccattttaaagtatatccgtgggtacattgtatctaccccccttctcctctctttaaataaacataaataggatcagcttcgtttttccagtttatatagctagacatatgtcacatacagagtgctatcttttaatggctgcatgataactttatacgtagaattaagcaaaatacttctagtacttgcaatagaatcctggtataatattttgttgtacaatggatgatgtaaaaatgtctcctaaaacataatgtgactcctaaaacaaaagacactgcttgctaaaatcatccaagtgtttctggttttgtttttttgtttttgagacagagtctagctctgttgccaggctggagtgcagtggcgcgatctcggctcactgcaatctctgcctcccgggttcagtgattctcctgcctcagcctctggagtaactgtgattacaggcttgctccaccatatctgctaatttttgtatttttagtagagatggggtttcaccatgttttggccaggctggtccgaactcctgagctcaagggatccggctgcattggcctcccaaagttctgggattacagtgtgagccaccgtgaccagcctctttatatgtatttttatttctagtttgtaaatccctgggattgggatctttgtcttttattccttaacaccatgcaaggttctgtctgataaggtctccatacctgtaggttgaactttttatttgttttgataaaattacaagattattttatatattcaaatttccctgagtattagaactgttgactaaatggagatacttaaagagatattttgggagaaaattgttttcttattttgtttaaatgataattgttctcctagaagccaaaatctgtctaatttctgactttatctggagaggagaaggcatcatagctaaagaacaattagggtggccaacttgaacgtggttcaatatcaattaagctttaattgctttaagcactcaggtctttttttccccctaaggcaatgacttatggggcagagttggcagtagctaagtaagatactataaattaatgttgtcgtaccaatttcaactgggctgtcaaacccaccctcagtttgctcttcatttacctctggtagcattcacattttgtgaatattaatttgagagcactttgcaagatgacagtgctgtcctttgtgaagctgtgttgatttacaagatgaattgttggcaaaggggaacagttgatctgaaaataactgtcctgcttccctggccagacctcgcccagtggacttcgcccaccttcccatttgtcattgttaaaggcaacgttttcttcattcttcagtttctctcttttctccgccagtcacccagggactgtcctgcagagtctgccacatgtattaatagactgatttgacccttgacgtgtgttagcttagaagatttagctttttgtgtgtgtgtcatcttctcatggaggggcccagggtgacaggttgttcgatgccctgagataggagacattctgtgaacaactggttgttgacagcagtggtgataaaacattgataagttggtaaagtttgcttcactgacttagagaggaaaaatgctgtttgacatcaggctgtgaattctggtttttcttttgtaaattgcctttctttggggcttatgttgctgataagtttatacttgatataattattttaatacttttaagtagttacatagagcgaaatgagacataaacccttacattatgtagggagtgaacttaaccattcttatacagaaataatataattcaggatacattttgaaatgagattacaagctgttcttatggagcgccatgtaaaaccatgctggtttttgtttttttctgaattagttgtcagaagctttgcattctcacaatactgaggggcattatgtttgccagcttttgatcatttaattcattgtatgtaagtaaatgtaacaatgttcattaatttttaacagttgcttatatttgccttaacgatgtaaatataaaaaataacttagttgttacagttagtagcctttcatttgatactcatgaagatttttgagtctttaaatatgaaagagaggaccttgtcgttcaaaaatgaaaaggaagtttttgttaagctaataattctagacatgttacaagaatgttgatacttatattggaaaacatgaaaaacacccaaaccgttgcatttatttatattccatgtgtatggaaaatatttttttaatgagaatttaaaacaatgtacacacttttgcttgttttatttccccaaggtaacgattctgatttttctgtttcagattcccgacagttaagcaatggggagacatttggctttgctcctgctttgctccttctcttccaacattttggagacagtgatggcagccaacgacttgaacagactctctgcagtttacacacctcgagtacaacgtcaccgtgcaggagaactctgcagctaagcttatgtggggcatcctgtcaagatgggtgtttacattacacatccagcgtgggaagtaggtacaaaattgtttccggagacagtgaaaacctgttcaaagctgaagagtacattctcgagacttttgctttctaagaataaggaccaaaggaggaaatacagctattcttaatagaaagtgaaggatcactacacattgatagtgaaagcacttgaaaaaaatactaatgtggagcgcgaacaaaggtcagggtgcaggtgctggatacaaatgacttgagaccgttattctcaccacctcatacagcgtttctttacctgaaaacacagctataaggaccagtatcgcaagatcagcgccacggatgcagacataggaaccaacggggaattttactacagttttaaagatgaacagatatgtttgctattcacccaaccagtggtgtgatagtgttaactggtagacttattacctagagaccaagctctatgagatggaaatcctcgctgcggaccgtggcatgaagtgtatgggagcagtggcatcagcagcatggccaagctaacggtgcacatcgaacaggccatgaatgtgctccggtgataacagcagtgacattgtcaccatcagaactggacagggaccagcatatgcaattgtgacagtggatgactgcgatcagggtgccaatggtgacatagcactttaagcatcgtggcaggtgaccttctccagcagtttagaacagtgaggtcctttccaggagtaaggagtataaagtcaaagccatcggtggcattgattgggacagtcatcctttcgctacaatctcacactacaggctaaagataaaggaactccgccccagttctcttctgttaagtcattcacgtgacttctccacagttcaaagccgggccagtcaagtttgaaaaggattttacagagcagaaataagtgaatttgctcctcccaacacacctgtggtcatggtaaagccattcctgcttattcccatttgaggtatgtttttaaaaggacacctggaaaagctaaatcagtttaaattacaacactggtctcatttctattttagaaccagttaaaagacagcagcagcccattttgaacttgaagtaacaacaagtgacagaaaagcgtccaccaaggtcttgtgaaagtcttaggtgcaaatagcaatccccctgaatttacccagacagcgtacaaagctcttttgatgagaacgtgcccattggtactactgtcatgagcctgagtgccgtagaccctatgagggtgagaatgggtacgtgacatacagtatcgcaaatttaaatcatgtgccgtttcgattgaccatttcactggtgccgtgagtacgtcagaaaacctggactacgaactgatgctcgggtttatactctgaggattcgtgcatcagactggggcttgccgtaccgccgggaatcgaagtccttgctacaattactctcaataacttgaatgacaacacacctttgtttgagaaataaattgtgaagggacaattcccagagatctaggcgtgggagagcaaataaccacttttctgctattgatgcagatgaacttcagttggtacagtatcagattgaagctggaaataactggatttgtttagtttaaaccccaactcgggggtattgtcattaaagcgatcgctatggatggcttaggtgcaaaggtgtctttccacagtctgagaatcacagctacagatggaaaaattttgccacaccattatatatcaacataacagtggctgccagtcacaagctggtaacttgcagtgtgaagagactggtgttgccaaaatgctggcagagaagctcctgcaggcaataaattacacaaccagggagaggtggaggatattttcttcgattctcactctgtcaatctcacataccgcagtttagaagcactcttccgactggtattcaggtaaaggaaaaccagctgtgggttccagtgtaattttcatgaactccactgaccttgacactggcttcaatggaaactggtctatgctgtttctggaggaaatgaggatagttgcttcatgattgatatggaacaggaatgctgaaaattttatctcctcttgaccgtgaaacaacagacaaatacaccctgatattaccgtctatgaccttgggataccccagaaggctgcgtggcgtcttctacatgtctggttgtcgatgccaatgataatccacccgagtttttacaggagagctattttgtggaatgagtgaagacaaggaggtacatagtgaaatcatccaggttgaagccacagataaagactggggcccaacggacacgtgacgtactcaattcttacagacacagacacattttcaattacagcgtgacgggtgttgttaacatcgcacgccctctggatcgagagctgcagcatgagactccttaaagattgaggccagggaccaagccagagaagagcctcagctgttctccacttcgttgtgaaagtatcactagaagatgttaatgacaacccacctacatttattccacctattatcgtgtgaaagtccgagaggatcttccagaaggaaccgtcatcatgtggttagaacccacgatcctgatttaggtcagtctggtcaggtgagatacagccttctggaccacggaaaggaaacttcgatgtggataaactcagtggagcagttaggatcgtccagcagttggacttgagaagaagcaagtgtataatctcactgtgagggccaaagacaagggaaagccagttctctgtcttctacttgctatgttgaagttgaggtggttgatgtgaatgagaacctgcaccacccgtgttttccagctttgtggaaaaggggacagtgaaagaagatgcacctgttggtcattggtaatgacggtgtcggctcatgatgaggacgccggaagagatggggagatccgaactccattagagatggctctggcgttggtgttttcaaaataggtgaagagacaggtaaaatgtttttattgctctcatttgatgcccttttccattttttttttttttttaaccatctccctgtggcagcttcttcaaaattccctgttgctctttgggctcggtatagaagtgcgttgaatattttttttggcccggctgctgtattgtagatgtgtttattcgtagtaagccataagatggaaacaaaagggcctgagtgatttaagtggcgtaaagtgagtaaaagaccaggatacattgaaattgttatcactgatactgatctccaaactctattttgaactctattataaaagcatcattatggttttgttctgactttgagaagtctttccaacttttttcagtcatgtatttgcaggctcatacttagaacaactactgctaccatctggcgtgccattcagagttgttgcacaccggcaaagttacccagtgcagagatgatgtgccaaaacttctctaatgggtcttcacttagtacctcgtctaggttttggtcgagaggcagaggcggggtagtggcagctgaactgaaaagacctggcttggaatcctggctcttctagttggtaattggtgatccggacaagcaaatgatttcttagaactaactttttcctcttctacatggggacacttagaataccggaaggtttaagtgagagtaaagtgaaataacacgggaaaactcctgacgtgtgtaggtttattcatggtagcagtgctttgttgtaatactgaaggttctgaaaccgggaccccaaggcagcagtccaagctagaaagtgcgtgtgttgcactttgtacatacctcagtctgctgcgcagatattgtagttatatgtcaatatgtcctggtggagtgtgagcctttcgggcaggcttttagcccctgcatcttctgtgtttagcacctagcaaaaagtgcctggcacatgaagctggtcaatcagtgttaaaagactgcaggagtaaatgagcgaatgtgttggctttcatgtcctgccctctgagaatgatagtggaaatagaaaaggggtgatcatagcactcatagcaataggtggggctcaatttgtttactaatctcacccatgtgtactttataaatctggcattttaaaagggacctttttaaaattacctttaaactttatatattcagtaataccaacacacaaaaaaacaagagagtcttcagtcaacacccaccctgggatccatgccatctgtaggtgtgtagcacatgaaaaatgtaactgctgtttagaaaaacattattttgggctggtgcgatggctcacgcctgtaatcgcagcactttgggaggcgcaggtgggaggattgcttaggccaggagttcaagaccagcctgggtaacagcaaaacctcgttcctaccaaaaaaaaaaaaaaaaaatgctggggtggtggtacacctgtagtcccagctacttgggaggctgagggggaggatggcttgagtccaggaggtcgaggctggagtgagctgtgattgtgccgttgcctccagcctgggcaacagagccagactatctcaaaaaaaaaaaaaaaaaaaaagttatttggaagttgtaatatattttttgtgcttctattaatgcaaggaattctttctctgttggtatgtgccactagcatatggcctatgtattaagtctacagactatatatcactatctaaatacccataattagtttatttcaagagaaactagcataatcaacagcatttgataatccctgaagagtagaatgtcttttttatcattttatctgtccagtataagttagaattttcaatactgtttcaacatagaaaaataccccaaatttaacaactgaagctgagtcaaactgttttgtaaaatttttgaagaacagttattcctactttttttccttctccaaagtaggtttaaaagcctataaagaactgttaaaagttaaagttgagacaaaatggaaccaaaaccttatttaaattctcttcatgactttgtatgaacactgccttttgggttttttctttcaagtgagaagagtatttttattgttgctttttaaggaatcatttcgaaactagtatttttcaccacacatttaagagattgggatatttttactaccaagaaaaaaaaaataaggaaacaaccgccaaacgaggtggtgtcccaaaatagatttatggtattttccagaaagggcagtgccaacttttccagtagtaatttagtgggaggcggggaggtgttgggattgtgggcagtgtggtggtaagtatataagaaactgtgtgtaaatattgagatttaaaggtgagagagaagctgaaatttgtaggtcatttattctgtggtccttgctttacagagaaagtaagtagtgtacatagacttacgtttatatgcttttggaaatgaacaaaagtgatagaataatatttacacatggacctcgtattcattacaagatacattttttggcagaagaattatcagcccaagttattcttcagagattcctggcaggacaattggtatcacagtgtagaaactcctttaggaaaatcagtatattttgttggctaaaattaggcatgctaattattcacttggagtgtgtcttactaatttctagggcatgaaggaagtgtggaaagatgcgtgtcaggtgaagagatggagggcagttgaggaacacccgtgggggctgccagagactgcactacagcttggtgtgccttgcgtgcacccggcccaggccaggctggtgcttgctggaacttcgctccttgcccattgccatgtccaccagggtcttctttgcctaactcgggggcatttaatattgcgctaattaattgagcctgtgcaggagtgctgtggctctggggaccaacaacctgtccacgtaactgtttcttcttgtctttgacttaaagctactagtgttggttgagtattataaccaaatttttgtatattttacctatttcaacctagtcaaatatgtgtatcatttatatacttttcacagaaagagaacctatccagcaagctgaatgaagttctattttaagatctttccttttcttctcttaaatctgcttaaattggaaacatcctctgaaacgtagttttctgtttttgtagaagtgaaattctatggactacctaaaaatctgtcaccaaacggacagtcctgttagctctgtgtcttagctccgtggtttgtacatgttctgcaaatggctttgcagcgagagaaagcgtagggcagagtggggatggcgggcgtggactctgcaggtctcacggtatcatctgcccttccggagaggcctctggatgttggtgaactgttctgacagatccatgccacgtgactgccctccatgtgaggtctggaaggggagagggccatgtgaaaaattatttggaaagtcggtctcttagagagccagtttccagagctctaattaagattctcctcctcagattgctatctgtaggtctacagtgaggattataaagtagatttaacaaagatgtttagcggagtaaagatcttgaagcatgtgtaatcccacattcagggttcggtctgcctgccatgcgtctcagcatccaccccctcttctacttcagatccattctctgttgctttgttgtaagcttcaacaggtttcctgtaatttaagcagaataaaatctggagcatccctcttgtgggtgtgtggaataaattggtgtagtgttcttagctgatgggtacttagcaagttaattattacttgagcaccaataaatgctgcagctttttgttcatttttaaaactaagggaatgtctagaaaaatgcctggcagaagattttgtagaaattgtgaatagaagttggtgttgaagcagtgttgggttgaggctgttccctgatgtgtgtattgcgtacaggacgccctggaatgtgtttgaccttcagtcagagtagtttggttctctttttggctgttaatgttagtatacaaagcagcccaggacgatgtttccccttctgactctacttatttggggagcccgtgtttttcattaagataagagcgatctctaaacatattactgctgtgttacttttagcatcccaatcctggtttcaggattaaatttacgttttgatgaaaagactgggaatgaattaatatggaagtacagccgttgtccaacttaagtcagcattcatgaaatacaggaagggaaatgaggacatttttcttaagagaaatggctgcattcacacgatggagagtgttggagcaccatccctgtgtcacctgtgtgaggccggctcctggcctcatgtctgtgtcacctgtgtggaggtcggctcctggcctcatcctgtgtcacctgtgtgggggtcggctcctggcctcatgtctgtgtcacctgtgtggggtcggctcctggcctcatccctgtgtcacctgtgtggggtcggctcctggccgcccggctaggtgcacacaggtgagtgcgtttctacagtgggaacggaacggaattccggcccaggcaacctgattgttgacctcagtcagggaaaatgtttctggagcttctgtctggttctgcaaactctgaatgtttcagctatttattattcattcaagttagaaacccttttcctcatataagtaggatattttacttacatcctgggatccctgctcctgctgcacgtcctcctgtgaaggagaaggaatgtggaggaggctgacgggccccggatcctgactaaagggtctgcaagggctgagagctgggtggctgctggaagcctggcctgctgtggtgggacctgatgccctggggagctggggctagaattcctggcagcaggaacttgattagagacgggtgggaggcccgcagagagttaaaaaatgtgctggtgaaagggcttttgtgttgctggctcctccctgaatggcagcagctgctgtcctcttggctctttatgttctcctcctaggaaagcttaagagaaagaagctcgtttcccagccacagggagactggaagttgtgtcttggcagaaatgatgtaccacagtgtgttgttgctgtgttctgggataaaaatcttgtgtgtgtgtgattctgagcaagcagggcgtggtaacaatttctaccaggggaagggtccttctttgaagcaggaagagttaaggtgaaaataggatctagtcgaaatcctaaggaagttccattttcttactaaaacaacagagattcagcttttctttagttatttgtatgatgtttaccacgttgatgcgttatgactgaacaagtctagcctggaaaggctgtggatgggaactcgggggaccgtgactcaggccgtcccacgttgtggagcagcacgcagtgacgcttaccgtgctgtgatgtaattctagagtgtgcaggggccgggacccggaggtgtggggtggaaacagcttacgtcagacaggcggctttgtcctcatgctgtcagtggtaatgacactggtggtgagcaccagtctagtaaaaccacgacactgagtgtcacagccgggcactgggcccggcattctgtgtgtgccagtcatttaattctcacaaccaccgggtggactctgttatccctacattacaggatgaaacgtaatgagaggttaagtaacttgcccaagacttcttgggtgctaagtgccagaaccgcatttactcctcttactctttgaagaatgatctacggatgctgcgagggagcctgttcaaaaagactagtgaagtgggtttctgtgctaagctgggttaggccaggttgcagccttgaatccagattcgatgcttggtcctgaaggagtcttgaatgtaagaatcttccagcatttttacttgaatgacatattgctatctagcacaattaggaggacaggagtttgaattccgtcgcggggcagtcagcaagtcaagatcaggccagcgaaggcgtgggtgaatccaggtgagtgccttagcttcccttgtctcattggccattgaagagatggacaggtgtcatatttgtgtttgcgttgtaaaagtgtgatttaatcggtaaaaatgctgcccatctgaactggacaggacgttattgttggaaggcttttcttgtggaaaccatgtttaagatggtggttaggtcccagcttcaggcctgcacgccaaagctaacgtgatttgtacctccctctgcatcgagttacatgagccatcgttctcttgccttgtcctccttggtgccttggcatcagcagctgtcctcttggcatctagtacggggcaagaaagccagagtaagcttactcaccgtcccccttgccagggaatgttttttgtcctaaggatgtttaaggattgggtgttcgtaatttgttgagtgacctgttgtgtagaggtttaatgttcacttaatacctggtctgttctttccgtattacctaccgttacaactatgaaaattgaaaagattttaagctttaggtgttagtttaaatgttggagatttcttaccatttagttcccattgtttttactttttggattattttagttcgtagggctgatttgtcacgtttttatttattagtgtgtgttttgtgtactgttattttgcagttgccttctggcatttttttttttttttcaaacagcagaccatgctgcttataaatagtgcatgcccatacaagacatagtgccacaaagcgcaatcttttctgtctttgttactaggaataaaggacttggaaagattgccgttcaagggcacatgcctgtacttgttgaattggcagttctcagtttcacagcagtgacagtaagtctaggaaactattcacatatatacttcaagggccgtcttatcaattaacttgccttgccagttcaacagtaccatatctcctcgaatatctgaaccatgttgaactcggtccattgctaggcctccgagtggctcaacctgttgaatgggatctttagaatgtcttactcatttcatgttggggagagtctactaatacagtctttttagtttaaatcaattggttttttgtttttttttaataaaagttactcagctatttatgtagttctgaagactgctttctggtttgtgataatttaaccatattcttatcacaggtaagcttttcttcttaatcatcatcagcatgtaattatagttaacgtttagtgagtacttgccgtgtcaggccctattttatggtctttccatagactgtctcactagattgtcacaattagtgagaaaattacgtggtgttatactctgctcatggagttcatgtctgtgccaaattataaaaaacgacaaatgatggaaatatgatgcacgtcgacttagtgccattgaattttgaaatatttgttgcattttttaaaggaaagtagcgcgtgccagttgatgtagtttatggtgtgatgcttaggaggcattctgacaatacagacgtgattcttgagctgaggtgttcatctgtcacgaatcctccttaacccgtttcactgtctcccatcgcacggggtccagtctctccgtggcgagccgcattgccctaacaggcctccctgctctcccatttaacatcacccgtgcttccctactggctcctgtgcagccctggtccctcagcccctgccctgtgcagccctctacccctcgtgcctcgccgttttctgtctccctgcctttgggcatacagtggtcagctcgtattatccataactctacttaataaagctttcttgacagccctcttcgttacgtggagctgtttctatcttttatgtacttaaacatatgactgcagtatcactctagtgtaattgtttatttaccgcgcctttcctctagattgtcagctctttgtgggcgcacctaagtctttgaatgcttgtgtatataacaggcactcaatgcataatggttaggctggcctggtaagccatcgtggggctccggggaaacctttccttcaagccaggtagcctttgcttctcttcgctgcgggggcattcctgtgtgttcctctgttgtagtgtatgactcagtgcgcggcctgtctgtgacttcatccgtctccatgaactcaaggacacagtccagcgtaatcatctgtctaccctcttctaacacagtggctgatagagcagtaagtagccctcatttgttttgtgagcaaatagattgtacacacagtaattgcagttgtgaaggttgagcgaagcttcttttctgccaccctggacgctatttgtaggctccaaaactgtggttcttgatggttttggcgtcacagaaactttgagatctgtggaaagctgtatattctttcttcagagagacagtgatttgattcaataccaagggctcagtgaagtgccgaacctgtgttcatgcactgaccgtcttcttggaatcctggtttgagatcctctgttctggaggttccagggttgtcagtcctcacaaattctcataaaggagaccagcgggtaaggataatggtgatgatgatgatggcagtgatgacagtgacagtgacagcatttttataatgccttacaacctgcaagtatttctacatacattatatggtgcttaagtaatagagaaataaaacctgtataaaaattataaatgagctagataaaccttaacaatgacaggtcacttttctatatatttgtacatgtgcctgaaatgatttaggagaaaccgtcttcaaggctgtttccaagtgaaataagaacctgtagttctttatacacctgtttcatcaatgttctgtctccccattgaggcatacggcacaaataaaacagatataatgaacagtgtcatcatccctcggagagcatggggatcggtttctggaccgtccgcgcacacccacatcttgcgttctgaggtcccgcagccggccctccacagacgctgcgctttcgcgtgctgtgagactgtgtttttgatttgccttcagttgaaaagagttcatgtgtaaatgggcctgtgcagtcaaactcgtgttgtccaagggtcattgatacctcgtttaagttaagcagctttctaggcaggctttggtctttagttttgccagctcaccatggaaaacccttaatgccacaccactgtattcctttacttattaaggcaatctgtcaggaaactcaggcctctaatgataaagttgctcccttggcagacagaattaattaattaattaattaattattttctaagacagagtctgctttgttgccaaggccagagtcgagttgcagtggctcaatctctgcctgctgcagccgcacctccaagttgaagtgattctcctgcctcagcctcccaagtagctgggattacagggtgcaccaccacacccagctaatttttctgtttttactagagacgagtttttgctgtgtggccaggctggtctcgaactcctgatctcaagtgatctgcccaccttggcttcccaaaggttggaattacaggcgtgagccactgtgcccagtccagaatttttatttaaatggacttccgtatgttctttgacctctatggaaaatagccctgccataagttcttagttaaaagatctccaaaatgcatttgtgggtcctggtttgcttttagctttctattaatttttttacttcctctttattcttagggctgcttgacattactctgtctcagacgtccgtgttcctcttacacagtgcttggcacagggctggtaccgagtagctgcctgctcagggggtgttcatctttcatagatcctgtgcatgtttgtcccatgatcctcttctttcgatttgttgcccagctgaggtgtttacatatttaagtgaaaaaaggcgggtttgtcatgtaaataccaagttagtcgttggttgaggcaacaaaatggaaatcagttattttttaaggatctaaaaaattttaaaggaagtgctttttcttaatagtgtggcaagctcatttagaagatggaaactgattaggaagtatgaacatgagtaatatccatatgtggttttaattggcagaatgttgatttcagaagaagtcacacgaagtttcatatctacaaagtatcaagattagagtttaaggtcagtaattttaaaataagtgttctagggcctatggccgggcgctgtggctcccgcctgtaatcccacactttgggaggtgaaggcgggcggatcatctgaggtcaggagttcaagatcagcctggcaacatggtgaaaccctgtctctactaaaaatacaaaattagctgggcctagtggcgcaacctgtagtctcagctgctccagaggctgaggcaggagaattgcttgaatctgggagctgaggttgcagtgagtcgagattgtgccactgcccttcagcctgggggacaagagtgaaatccgtctcaaaaatgtgtgtgtgtgtgtgtgtgtgtgtgtgtgtgtgtgtgtgtgtttttatataatacatattaaaaattattttagcatgtttaaaaaatctgcttttgtcatttgcttccaccagaatataaggctgaaactggactctgtccgtgtctgtatcacttacttagaactgactggcatctaggcatccagccaatactggttgaatgcgtaaaatttaaaatggaatagattgtaacaaaatactaaagggaaacgcttatctaaataactattgttgagaaacccttttaaatttgtcctttttaatatagttaaggctgctcttccacttgagacacccttctcccataccttccaaaattacaagaataagaacaacaaagcagtttagtagcaatgcggttcctctttgtttctgctttgcttacctaggagcagcctcctttgtgagattgagtactagattctgaggctggccttccaggtgaatatacctgagttacgtgttgtgtccttggctgtagagtagtgctattgcctgtatcatcctctggattgaaaagtatttcttttgtttaagtataaaagatgagtatccattgccattgcacattattcagcaaaaacttgaactctaaaaacgttcagattagtaggatctatttttgttagtatcattattgatgaatttcttaaacttaagaaaatagttacttctagagattcacagattatttttgaaactgttggtttttggattaaattgagctcacccaactatcctttgaaaaagctgttttgtatttttgttttttttgtttttgttttgagatggagtctcgctctgttgcccaggctggagtgcagtggcagatcttggctccctgcaacctctgcctcctgggttcaagcgattcttctgcttcagcctccaagtagctgggattacaggcacccgccatcatgcctggctaatttttgtattttttgagagacggggtttcaccatgttggctagctgatcatgaactcctgacctcaggtgatctccttcctcagcctcctgaaatgctgggattactggtgtgaaccactgtacccagcctgtttgtattttaagtgtcttggttacttctgtggagaggtgcaatttacttaaaaccaaacctttcttttaaagggtggttgaataatggggggaaatttagttagttaccagactctttaagaaaaataatatgtatgtaaactaaaagtagttttcttattttagtaactacatctagtaaaagttttttaaaaactcatttgttctttgtcaactcttcttgctacttaggaacttgattctaaaccttccactcatataaatagaaaattatcagtagctagttcagttaactcattattctatttaaaagtaactctttaggatgattaaaggaaggaaaggaaaccgttgggaagttgttcactgtgtatttgagtagaaatctgttcatagcaagttgcatttgagagggttgagcgttatgagaaatggggagatggtggttaggttaggtgagaggcaggttgagttgggagatgttgagtttcgttagaaataggaagatggtggttggattagtagatgagagcaggttgagtctgggagaggttgagtgttgtgagaaataggaagatggtggatgggttgatgagaggcaggtcgagcttgtgagatgttgagttttgtgagaaataggaagatggtgttggattagtagatgagaggcaggttgagtttgggagaggttgagtgttgtgaagagtgggagatggtggttgggttagatgagaggcaggttgagtctgggagaggttgaatcttgtaggaatgtggagatggctgttaggttagatgaaatacatgagaaactcaagtggaataatgtaggcaaatccagagctgaactgaaacgttttattgtctttgggccaatattaagtatgtgaaggaaattacagagaatggcatttagccttttgttgggaaacaaaccatcccaaacctcatagcttagaacagcctccactcatttgggtcaccgttctgtgggtgggcgattgggctgggctcagctgggtgtttccttggctgttttccacgggctgactcatgtttgatagttgctgttgagctcgagggccctgctcccaggaggtggctgggtgttcgctgcaggcgcagctcctaggccctgtgtctgtgatcatcccgcagcctgtcctggacccgtttacatgtggtctcggggttctgggtgctcgaggaaagcagcaaatccgctgggccaaggctcagactcctccactgtcatctcccacgtgctgtgacacagttcgttcatccagccacaggtaggaggtaggctaaccttgctgagaggagctgccgagtactgtgttcatgttcctacttcagaggcacttttacccaattgcgtttccctttgagggaatcccttctgaatgttaaatggcattactatataaaggcttgtgaaaattgtgaaaatatcaatatggtcttaaaactttctgtcttacataacgatactttaagtttgtcatactgttcaaacatgtaatggcattacgtatatcttcaagttatttttagcacatttccatttaaactagaacgtaagcagagatacagggggatgcttgaagtctgaagataccaaagcaatgctcctccatcgtcttcctactcattttctatcacaaagatctctgaagtttcttacccccaaaggaattggagaattccattatcgtgtttctaaagtgaaaggcggagagatggagtgtctggtaaagggcagcaagggttcttcacgatagactttggcctgcagatgttcgtttttctcattagcaccacttcctctaattaatttgtcacaaactatctcattgatttattgctgtcccgtagagaatggaatcttggggaaatggaattggaagtccatggaagactggggggcgtggaaatagacaccgaatgaggagagaatataggagtgttgatttggtatctttaggtttcatgcagccctctgaatctctgcttaagtttcagcttaaatggaaaagttttaaaaataacctaagattcccagactttgggaggccgaggcgggcggatcacgaggtcaggagatcgagaccatcctggctacacggtgaaaccccgtctctactaaaaatacaaaaaattagccgggcgtggtggcgggccctgtagtcccagctactcgggaggctgaggcaggagaatggcgtgaacccgggaggcgagcttgcagtgaaccgagattgcgccactgcactccagcctgggcgacagagcgagactcgtctcaaaaaaataaataaataaataaataacctaagatgtattttaataccacttagattttgctaattttagcttatattagagttgtttgttacgggacgtatgtgcaacagttataggaaagtgctctgtggtaagttgaaatagaaatcttaggatttgaaatagaaacgttaactgtattgactcactaagcattttgacattatttctgtttggaaattttgggagtgatgtctttgaacacattgacatatacatgggggggaagaaaaacaaacttgtggccttcttaacagagatttttagagaagtagtaagtcccagctgccattcttctcctcaaagagatagaaaaagaaccacataaaaataatcattattataggtaaaaaaaaatagtagccacataaagcatacatgtttattgtttactgcttgtagaaaggttcagtgatcattaaatgtcgaacgaatcgtcttgtttctgttttttttaatattttattttgtttttatttagagatggatctcactttctcagactggagtacagtggcacaatcagggcttactgcagccttgaatccggggctcaagcaatcctcccaccacagcctcctgagtagctgggactacaggcatagccaccatgcccggctaattttttttactttttttgcagaggtggggtcttgctatgttcccaggctggtctcgaactcctcagctcaagtgatccatcctactaccttggcctcccaagcgctgacattacagatgtgagccaacatgcctgtcacgcctggctcagtggccttgttctaacaaaaaattttctcatgaaatgaaatgaagattctgtaacaagttagttgacaactttgttagaaacctaatgtagagatggtgacttaaaatgtgatattctcataaacagtagtcttggatatagtatatagaagatcatgttagcgaagagaataaaagtcttaaattgttcttttggtgttagagatgaatctgcactagaggcacctaatcagcacggtgtactcttataagctaaaacaaaacacaacagtgattcatgtcccagagtagaccatgaaaccactattagaaatattccaaagtttactgtttttagatacaggtgctcatatgtgaaaggtgactgatttttacaatttatattaacaaaattgtgcaaattctgccactttttaccgttaccgttattttttaaatcaaatgaattagtataacaggtcaaaagcagcactgcccaatagactgtctttatttgtaattttatatattttagtagccacaataaaaaagaatataacagtgaaattttaataatatattttatttagtccaacatatcaaaaagtacaattacagcattgattagcgtaagtattaatgagacctttaacattcattttttcctatgaagtctttaatcagtgtatattccacccttacagcaaatttcagtttcgactagccccatttcaaatgcagtttagagacttatgtagagttcaactgccttaaagatatttgtgactttaaatttggtagtgggctactagattttttttttttgaggcagagtctcactctgtcgcccaggctgggtgcagtagcgtgatctctgctcactgcaactcctgggttcaagtgattctcctacctcgtctcccaagtagctgggattacaggtgtgagccaccacacctagctaaatttttgtattttattagagacggagttttaccatgttggttaggctggtcaccaactctggacctcagtgatctgcctgcctcggcctccaggtgctgggattacagacgtgagccaccgtgcaggcattagattttcttctgtgaatgacgtacacgaaataagtgacctagagctacgtctctgtcattcactttggttataatttttttgcaaattacctatgctggaatcttttggggttgtgggaatggttttgtttctgattgtttttacttcctcaactgtcctaagattaccagcatctaatgaatagtaaacttgagataacggcttcatgcctaacaagtataatttatctcttagtctcaagtgtttgctcttctttttaaaatgtttctttttagagaaatacagctttgattctactacacttttctgtaacgcaatgcagtaacatgttttttgtttatttgtagcttcctatagggatagggaaaatgtaattgaatagtaactgaggaaggggctactaaaaccgagaaaaaatgataggaaagttactctttcccttcatttgggtgatgggaaaaagtaggatgagatcttctaatgggcttgtgagtgcggtagtctttttaaagagtcacatggtgtgtaattttcctctggatattaagagatcaccaccaacaaagcaaggcttgatcgcccagggaggtggtgtgcggagtcgagtcgtgtggcgggtgtgcatgcccttgtgggaaaggaagggaagagttaagtagttctgcctgttgaattagcctggtgtgggtgggtgccagatacctgggctaaggacattcaatgaggatgttaaaagcctattacactggtgttgctgaaaattatttgttgaagaggctggtggcctagatcctggcatggctttaaaaatattacagtgagcaattcttgtgatgttaagcgagtgtgtgagctcattttggagtcttttgacttggacctctctcgctttggttaatgagtgtggaaaaacagcccagaagttaatttaaaatcagatttgttttcaattaaaaattgtccatgatgggtcattggatgtgaatgcaaaaagaaaaaaatgtccagtgatagcttttgtaaaattccgagtaaatcatgtgtctttttgaggataacatttgttattgaagttccctcatttaaatagctttttggggggcataatttggattttagcataattctaatttgatttgacgtacaagatacaaatcttctttatgtgaaagtattgacatcttaaagtgatatttttacagagtgattttccaaaagatttatttagaccaggccatcatttccaagtgaagtgaaatctttattcattaactgtaaagtttctgtgggcttcacaattgctaacatgtataattaattcaaaacccatgcttttcacacttctttttgaaagtagttgctttctgtaaacttgacctttctgttgtttcaatggcctgtttattcttttagagttaaaaaggtcattttcaggtttatggaattttccatgtaaattttgggatctgctgctggggtgattttctgctttatatttattgcggtactttttgtgtccttgggtttaacgaatacaggttatgaaaacctaccctgccacattgtggctgctgcctttgtatctcacgatacacctgtttcatttgggcttcatcagtttcacgtcaagagttgtgactgaagcttagtaaatatgtttattttgtgccggctgctggctggaaagtctactgtagcagctgaaggtgtgtgttttttttggggggggcggggggggtactcttgctgggtgaaccatcattgtacaggtaaatggaattcgtcaataaagcttgaattgcgtcccccttcatttcttccgagtgttgaatgtagggattgtcttgcttggaaccctattgattaggtcacagcctggtctgagaaaacagagctgcccaggggccatctcactgcaggggatttgccgaagcccctgtgaaggaccacatggggtccgcgattaccttatgaacaggaatcagttcagggagcagatactattaaggacctattaacttctacaggcttctctttgacttgagaagcactggagagtgagattccttcacacataatgaaaggaaattattgccaaagccaccgaaggtgcatcttgcatatctctgtgggtgcctctgttgagttgcaaatttatttcctgctggggcatctgctagctttagaagtcccatttaaggtcatgaaaagggaatttggaaatgattacatagtgtggctttttttttttttttttttcagctttgagtctccatagcatttggacagaattagcaactcccctcattaaaaaaatgatctttatttccaataaaaaggcagtatatagtcatttagaagcctgggaaaatgtaaactactggaaaggagaaaacatgactaaaattttactactagaaccctggtgaacttttcccctaactcatatgtacctgcacaaagatgcctttccgtgccaggtgcgggatttgtaaaaatgatgaacagaaaacatttactgaacgtgtagtttgttgactgccttctgctatatccagaacattttctggttggtaggtattcttaaagaagtgatttttagaatatagagtgccagcacagagacagactaatagaagttgagcatcttatctgaaatacttgggactagaagtgttttggatttatttggattttgagatatacgcgtataccagttgacatcccacatccagaaatctgaaatccacaatgcccagcgcaccatgtggtgctccaaagtttcagattttgcagcatttcagattttttgatttgggacactcatctgtttgtatagtaatactcaatttttgaatatgtaagttccttgtttgtgtgtatctcgttgccttagcgtaaataacaggaagtgaaattgctgggtgaaaggtaatgaaatttttaaagctgttctttttttttgtttgtttgtttttatgagaactagacatcccatcagcagttgtgagtgcccatttctctgcattcttgctgccactgaatatttggatttagaaacagaatcaaaatgatggcagatttatgagtggaaaatactaattcagtcagggaactatcatattgaaacagtggttgttagttttgtggctgtggttctggttgtgtgtttaaaaattctatttttataacccaactttttgggatcatattctctgatttaacttaccttttctcgattttgtccccagtgcatattgaggcttatttcttcacattaattaattgtttaaaaagcgctcttgtatgccagataaaggctaatgagggatggacagactgtaaaatatgctttcaccttcatttcattggccagatgctacttcgtaaaatcagaagtagttgaatttttcgtttcgctgctatcaggcttgtcaaattaaatttaaaaatgtaattttgctgttgaaatcaagatataagttctcttttccttcccaagtatccctatgagttaattcactcacctgtgtcctagtgtataatcagcagtgtagtgattggatccaaacagatagactgtttcatgggatctctgagaacacattatcaaggatgtgatactaggcaataagcagttccttggcagctataattcatgttaagaacttggaaaagagtatgaggcggataaaaggcacagggttctgttacaatgcagttgggaaaagaacagcttaaaaaaaacagcgctaagcaaaccagtttaaattgctgactttaggcaatagattcaataattaaatattaaaatgagatttgtattgaggagagggttgcatttcaacagagcaggcccagatgttgagattagtatattgatttaatttgccaagatgctttcattgagcccttggaaaaaagaacactcattcaaaaattgacacaattttattcttcattagcttagtgttgcatacttacataattctggtatctcataaaaatgcaatatagagtctgatttaccaataaaatgatgaatgtggaggaagaatgcaggaaaaaatcgctacatgttttcttcagaatgtcggggggggggtgaaaattctcaaataattaggtgcacaaactttctgccttcctgcaccatggggaactcttctaaaggcagcagtaccaatgaatgcatctttaatcatctggaagtaagaaatccattatttttctaaaccagacatagttgtctgttttaatggaacagttggttgattacagctcttcaggcctttatttgctactgcccatagatatttgagttccagcttccaggattgtcataagtgagtcagagtccagaatttagagtaggaatctgaggttgatgaatttactttggtgtagagagtttaactgaggaagtagatttccttatacagattctcacaaccggtgtgcttacagcttgctggctgctagagacggactcatctacaaatgcaacctaccagatagagcaaagctcaggacctgccgtattctcttttttagtagagagagcaatgctcacctcagttgaagggaatacgagtctttacagatgtcttgactgtcttttacagtaaccaaatgtatgttggttttatagaaatcgagttatgttttaattgtagaataccatatgtagaaagcattatgcaggttgaaaataacactggttaagtgctttgaaaagttaaaggaacctctgagatgcagtcaaaggaaaagtaaccagagtcaaaaaatactgactgcgtaatccttacctaaggaatataatcagaaacataaagcaaccccaggccacatatgctggttagaaactctgctgtgaattttagaaaatctagtgaagatgtttcatttgagataggaatttttaaccttcatatattttatggtgttatgaaaaatagaggggtttggctaagttgctcttattgtggtggtggtttaacgttctctcggttccgtatcctatcagctattggacattttatttaaggatatagaaatgtttcgttcagcttattcattcatgaaatgtaagacttattcttcctttccctgtgagaagagccttgcctttctggaatgctttgtttgatctcagtgtaatgcccttggagtgcccttcctgtctgaaagaaaggtgaggtgaatcaaagtaacgccagataaggcaggaatgtgcgctcctgttactcctgtgtcactctggctttgagactgtggctgtatactttacctttcttgcccagggattagcgagggcactggctgactttcttccctttagataatgtttcatgcacaaatagacttgcctgcttccttcctgaattcatgacttggttgtggcataaaaggagttgccgaataagaagagatgagcatttccagttagtcaaaactaaacagagtagcaaatgaaaacacgcctcctctgtttaatatgttacgccctatccagaggtgaccgtttttgtttaaattgttaaattaaaacaattgttaccctgtttgtattacgtgtctgaaagtgtttcactgtgtgcgttaatactggtggggtaaagggagtttggggttgttttttccctcttatcccccagttagtgattaacatccagtcattcacttgtgagaggaatgttagttgctttagaaaatcatggtaattatttaaagtgtcctaaagaaatgtggtagctgtttcattctgttgaaaagggccgagcgtcagttccattttctgtgcatggcagtgttcgggcggaggcaggtgcatccggggaggagcacagttcatggtcctacgtctcctacgagagccgacaggaaatctgcagagtaccttcagcccctcgcagatactgtcctggcccttctaaagcatccccttcccaggtccagcacggaagcactcctataactgtgccgtgagaccttcatctgggattggataagttataattggagaggagattcagtctagatgagacgattaaacaacaagagaatgtatttaatattgtcaaatacccatagttcataatgacctgagttggcagttaagactcctagtaatgaagaatttcttacagatttaatacattcttaaatacagtaaacaagaaaaatctggcttattttattcagtaggtaagcatatgtttatagttctatttaaactgttaatttcttattcaattatttggataagtgaattatgtaatgcctgtgtgttggctcggtggattaatgaagtagcaatcttactgttttgtagctattgaaaaacagctgaaaaactcagtttgttaactattacatgcaatgttttgtgattaaaaaaaaattccctctgaatctttttggaggatcactgagggaatttaaccacttttacatttttcatagggatctctgatacccaaaggattaataataactccagagggagcagaatgaagctctccattctggtgatccttgagggtccatgaccacagggagaagtcgtgtattggactagtctagaaccctaggaggaggtgtggggaaatgagagtgggagggagaagagtggcaagtgtgcctgctccaggggccgcggtcagcagctgcaagtcctgctgtaggtcctggaaggaaaaaggctttggagaaatcagagtggcctttgaaagcaaaactttcggaaaatttcacagaggcaagatttgagagggtaaagaaggcttgggtgaatgcccttccatgcattcattcatctggtagttgacgtttatgaccgcctctagaatgccagaacctgctctaggtgcccaggactccacagtttgcaaggagacggtgctgtgcccttcttggagcccaggactccacagtttgcaaggtggatggtgcgtgcccttcttggagctattcttctggagagaggagacacgagtcaacacggagatgagagaaaagaacgcacagtttcagctgagcggtgctgtggaggaaaacagggcatgtgttaggatttttgcagggtgtgcatggcctccttagatggagtggtcacctgaatgacaagaagaagagccaactatttgaagacaatttttaatcagagggaataatagccctgaaacacagcttgtatggtggaaggtctgggatgaggtagttaaggtaggtgcgtggccaggacatgggctgtggtctgtggctgaagggaatggtaggaataccagggcagtcagtccagggcccttacacgggagtgaccctgccttaccacaggagaggactccgttttgtggcacacactctcctttttcctgctgctgactgtcctgctgtcctggagtcccatcgctaggttttatccagtccaggctttctgcctggttcccccttggggccctcagtggtgtttgtagtcactgagacatggagaaaagaaggaaaatcctcctctgatctgccgggctgcctctttaagtggcatgtcctgccagacccagtgtcctctttgctaacagactttcttttggatgtaaaccctgaaataagattgctgttttaactactttaaaaacaaatcattaaaagttgttttctttcgaagcatgtttttagttcaaaaagtctgtcttcatgcatacgcatcatgttagaaacattacaactttctttttttttttgagacagagtctcgctctttcactcaggctggagtgcgtggtgtgatcttagctcactgcaacctccacctcccgagttcaaggaatcctcctgcctagcctcccgagtagctgggattacaggcacatgccagcacacccggctaatttttgtattttagtagagatggggtttccccatgttgaccaggctggtctcgaactcctgacctcagtgatccacccgccttagtctcccaaagtgctaggattacaggcgtgagccaccgcgcccgctaacatttacaacttttagcaattcagaagataagtaataatattttgaaagaaatctaggaggtgcctgattcctagtcctgaatctgggtggcaacctaggttttcttcccagcgttagataaggagatcatccaacgtcccttatcgcctccatatgacaactaataatttttatatttggtgactaaacacgaactattatgctttacttttattttggtaatcatgatacttctagcaatgacttcttttgaacttggttagtctttacttatagatccgtaaccagtctgagaaagtagttgtgacaaaatgtaacgaaaataagtggggaaagatagttatggagcaaaggtggactaatgttcctttctgtgtcccagaaattcctaatttgacttttcctggttttattgtcctttcatgtttgaaatgaaactttgaaacgttttataaaagtagctcttatttggggctggagggaaagtttgtggcagacctcactgccacttcagcggtattgatgatactgtttcaggttaaaaatgctttacgctgtcagttgaaataactcatcgatgtgtccagtgaacaacgttgctgtggattctgactttcttctgtgctgcacgtatgtgtgtattcactttagagcactgctaatgccggtcccttgtcttgataaggaatgtcacctgggctcacaataagtgattctaagttctcttccgaacaccgcttccatcatcgtgtgatttctgtagtagccagtttctgtcttgaataatagcatccttggaaatacagaggttagggattaagtgtcatacctctttaagaatcttcttaaatcttggttttgctttagtttctcaaacataaaatagattcaatagattaaatacctttatttttatagtaattcttataacccatatactcccacttttaaataagaggaataataaatattgatataaatagtaaatatagagaggataataaattgccaaagtcacacatttattaaaatgctgagttgggacagttaacaggctgctgtaaggatggttgattataaggccaatactttgaagtaacagactgagaataaaactacattcactcttgtttccctctccaattccgaaataattcggtgatactcttgaccatgattgagatgtgtgcctaggtcaaagtcactgataccatgttaaggtaaggccgattatttttaagctttcttagggtctggttggcagatcattaactctgagatagtatcattgattttgcttttcctaatgtgagccatttccctcaccaatcagaaaagccgatttcagtctatgagatttgtgttaatgcaagcgtgcacctctctactaggtgccactctcgaacgtagctgagatttcaagagatttgggttccagttatggctttgattcaagctctgcaacctagaacttgtgaagtcatttattccctggacttccttgtctgtaaaattagagggttgcactgatgatctttactgctctcttttaactcttgttctttgctgattcgttggtttgattattaagataaccaaacaccatgctttagaacttacggtggtcttggagctttatgaggtaggttcatgtaagaggtcggctgcccaccacatgtgcctttgtaaaggtatttgggagtgttttcttcccttccagaggggcaggggaggagtggtgcctgaagagagaaatgttacagaacggtcgtgtgtaattaaagcctattcagtgttttcacagtggtgtcaccaacaatgataactcagtcatagtcagatttcatgtttgtgttatatgctatattactggaatttgttattttatcttattgaagaacataataggatggcttagcctttgcttctcaacactggtaccctttgcgtgtctcttttgaacagattgtgttagtctgttgagttgtatttcttttttaggtcaataattaaagccagggatatgccagcattatttcaaaataggcttatcaagggacatctgtcaaatgtcttcagtattaggttaaattaatcgaggctttaaatttgcagtcggttgggatatttgggatatttccctgttccaattaggtaatgaaagcattggaagacaccatggtcttctattaatgggtacagttagcagtaaacaggttagtttactgggcctgtgattatggttgattgagaatttataaaattatgaagtagttctttagatggcacgttataaaaattcttgagtttcagattttaacaaatagcctgctacagcaaaccaaccaatgtagaaaataagtgggaaaaaatatacgattgcttcaccacctctttcataaattgctgaatgaaaggcaatctcaatccaagagtttagcacaaagtcatttttcaaaaatcatcttctaactgtagacttgataacatgcttttccttttgaacccatatatctgatactgtcatgagcggaaatatttgagctttaggaatggcaacagtgttgtaagtactatgctatgttttttttttcccatgttgaatttgtatttaggttttggaaaaagcagacagttttttaaataagagtgagatacttcctgcttatggatagaaaacaaactcagtttcctgaattagactctcaaacatgcttctgacaccagatgtgtggggttcccccaacccccattttttttttttttttttttttttttgagacagagtctcactctgtcacccaggctggagtgcagtggtgcgattcagctcactgcaagctccgcctcccaggttcacgccattctcctgcctcagcctcccggtagctgggactacaggctcccgccaccacgcccgggtaatttttttgtatttttagtgtatttgtttagtgttagtgtttttttgtatttttagtgtttttgtatttctgtgtttgcaggatggtctcgatctcctgacctcgtgatccacccgcctcggcctcccatagtgctggattacaggcgtgagccaccgtgcccagcccagcctaaatatttttttaaacaaaaggtattttactgttccaatcactgaagaaattacagggcacatgtaattcctttttgtgactgccagtattccatcgagtatgtgtaccacattttctttatctagtctatcactgatgggctttgaattggttccatgtctttgctattgtaaatagtgctgcagtaaacatatatgtgctgtgtctttatagtagaataattaatattcctttgggtatataccaagtaatgggattgtgggtcaaattgtatttctggttctagatccttaaggaatcgccacactgtctttcccatggttgaactaatttacattcccttcaacagtgtaaaagcgttcctgtttctccgcagcttgccattcccctgtaatttcttatatgcaggcctatgtatatatatttatgtatgtaaatgtatataaaagtaataatatattaataacatatataatacataatatcaataatataaataattgatattaatgacaatatatgtaatatatttacatagctatacatgtataaaaaaagtgataatagaatatatttgtctataatgacattgtataatgttctattacattaattacaataataaatatttatttattattatattataataaattaatacagtaggccaggtggcctccacctcctgggctcaaggatcctactagattggccttacaaagtgctgggataccagcatgagccactgcgcctagctatttatttatatttttatcttctccgatacgtaattttagtaaccaccctgctacttaattacaactagtgtgttataatgaacacttgtgttttttgaatttgttttttctagtggttagtttgaatatatgcttttcaaataccatcaatgcttgatatccctgtgatgtttattttcatattctacatcttctgttatcactttatttattaatggttagtattaaagaagaaaatgtcactttaaaatgaaatgtttattattacttgttaaagaacagctctcttaatgaacaactttgctctcagagaaagttaaggacagaataatataagaactactgcagttattctctatttttcattttttcttgtttcagttctggctttaatttttagtaatgtagatacatgacagttatttgagacttgccaatctattctatatagtcttttaatgtctccagcaagatttgtcttcatagtctctaaagtgatgaattgcagtaatccgttttcctcctgttttaattctctttcaaagtactttatgagatttgttcctgtttgcataaaatagtgcatattaaatacttcatttgtctgccccacagttaccacaagaaatcttggttaagattgttcagtttctgagcatatactgggtattgtaggaggttgttgagttttgattgcttacctctcaattttagaatcctgatacatacaggtgtgccctttttgtgatttcaaaacatatataaaattagaaatcttccgttatatgatacaccgttctcattaaaaaaaaaaaccctgaatttagaaaacgggagttatgggattaatatgcatttcaaattgatgttttgccttaacgaagattcttagccaggtttaacatcaaatcttgcaggcatttagattattagatagggctgtttgatttaatatgaagcgttagcataaaaggactatctgaagtttctcctaggttatcagtgtccgtgaatcacttcctgattaggttagctgacctaacttaagcttctgagttcttacaggtattggttttggcaacaaattgggtattgaagtagctgaacactgcttgtaagtagttcgtcttcagtttgcaatttttaaagtttaagatttgaattaaaatttaagaactgctttgtaattgaaataaaatttaatagaaaaagagtttctaaaaatttgataaaagtggaggctggagtaaaggaaaatgctacttgggaatgatgggcaggggggcagcttatacatacagtccatgaccacagggaccaaaaagtcaatggacttttatttgcttcagtcagcattcagttcatgtaaaacacaccttcctttttgtaaactgaattgcatatgattcttagggtttattttgagagcaatagttgcggttttctgttttataatctgtttacaggtgcctaaacaaaccttagaaacaggaaaactggcccttccccagctgtgtgcattctaggactccagagacaactgtctctttggagagagttctgttttacagagaccaatgtagtgcttgactgtaacaggaggaatctcattccattccttctttgcaagggagtgctttaaggagtttggcatgaggcttagtcatttcaactgacattttaacattgaatagtgccttgtcttcttgctggaacacactttgcagtacaagagctttaggcgttgttattcagcctatgaaaacctgtaagtcactcttaacttttaaaggttgcttttaatttctgaaattccttaagttctccttatatgcttcagattaaccctttatacacgttgtttaaaaaatatttttatataatacatgtatatttcttctagaaacattagaaaatattacaggaagaagataaaattaactcatccgtataactcgccatttttcttgcatatcctctctccctgtttttttttgtttttttttttcacaaaatgaattgacatttatttttttaaatcactttattacatgttgcattataaaattcaagcaggaactcataactgaagaaaggtttgtttggtctttgtgtaaaagatacttatacaataaatggaaaataattattaaagtcctagttgttaaaatgctgtttcccttctcaaacaggtgcccttcttttcctctctctcgctggtccaaggaataagttactcttttatttaactgtcttctcataggacctcattttctcttctttttgtttcttttgcaccttgtagcatacctggcatgtggtaggaactcatttgtgttgaatgaattaaaacaggtgtaaatcaataaagccaggttccagattaagatccagccagtacaaacaacattaagtcccttgttgaaaaataaggtacagcttttaaaaattattgtgtgtgtgtgtgtgtgtgtgtgtgtgtgtgtgtgtgtgttttagacagggtcgtggtatgtgtgggtgtgtgtgtgttttagacagggtctcactctgtcacctgggctggaatcagtggtgtggtcatggttcactgcagcctctgtgatcctcccacctcagcctggagctcaggtgtgtgccaccatgcttggcaaattttttgtatttttagtagagacagggttttgcatgttgcccagcctggtctagaactcctgggctcaagtaatcctcccacgtcagcctccagagtgcaaagtggagaaattacaggcatgagccactacatctggctggtttttcttttttttttctttttatttattgcccaggatggagtgcggtggcgcaatctcaactcactgaacctccgcctcctgggttcaagcgattctcctgcctcagcctcctgagtaactggtacacagggcacaccaccatgctgaggctagttttttttttttcttaatgagatttctttccaaagagggtttttccttaaaacgtttctgttgatctgccacaaaacttttacagctgattacacttcagagctctacatctgccacccaccactctagtttttttatagttaataacatattcaagactcagttataatattctcgtagttagattcagtattgttagtataatgcctatacctacttacacctagtatatttcagttaatttagcctatgcaggttttttgttttgtttttgtttttgagacaaggtctcactctgttgcccaggcttgagtacagcagcatgactcggctcactgcaaccttgacctaccaggctcaagcgatgcccctgcctcaggcacccagtagctgggactacaggtgcctgccaccatgcttggctaatttttgtattttttgtaagacgaggtttcgccatgttgtccaggctgtactcgaactcttgggctcaagtgatccaccacctcagccttccaaagtgttgggattacaggtgtgaaccactgtacctggccgcctttaatacataaagaagatatgataaacacagtaacttcctaaatagagagcagtgttggatttttttaatatccttttttcttttttatcctaaatgggcctggtcacacggagttcttaactctatacagggatctgtttggccttcctttagttgttataacttaagttccatcgccctcccaccacaggcaagtgctggtccaccttggtggatgtgttgcctgtttttccactacagtgattgattgatgagagtcagacctggctgttgaatcacaactctgcatctcatgagatagtaccctctggttttatgtgtggactctggagccagtcagccaggtttggggtttggcttctctgctaccaaagttggataactgaggatgacttccttaacttttcaggctagttgttagatgtaaagctctaagatgactaactggtaaggtaatccattaattcattggtactttattacggagtaaataacttcagaccagtgacttttgagccttaagcctctgctctgaatatggaaaatggggagagaccactgggctaattgtgaagattaaacaatatggctattaaagcttttactaagtctgcatccagtccgtataaggggagaagagtaatcaacatgaaattgcgtatcttctgaaatttgaaacaaacttccagaagcattgccattggtaggaaaatatattctctgtatcttaatgcttctgaaggctgtcttgtggatgtagttttatcaattaacaggtgtccagatgataagttttgatacccaagggtgatcctctttaacagtaagcttatccacaaaagccgtcattgacaatatcagtgattctgacagggaagtcagaactggaatcattcctcaacaaagcgggacaacatggtttagcagagcttaccctgggaatgctctttgcagagctaaagaaatccctgggcttgaaacatgatgcttaaaatctgattattacttaattaatactacgttttagtaagtttgcaagtcagaaagcttcctcagctaatttgaagttattgcagcaattttaattaaaagaattgataggtatatgttttaattaaaatatttaaataggcaatctaaataatgcaaacagtgacagttgtgtttttgcttttcctttgtcattgacttatgatctcattctgggcaatgtgattatagaatttcctagacctaaagtttgtgtaagtagttacctacataaatacttcagtgttagttatcgaagctgccagaattccattgtcatatatctactcaaatgaaacagaaatacttaaaaatgaaagtacatctagacatagacagaaaaataaaacagggaggttctgtacataaaaccttctgatactgggcgcaggtattgttttaattgacttttattgtatacattttaaatatagatttttaaatcctggttacagaaatttacagattaaaaaagtttctgttcactggatggatttatctgctgtcaccttgtttatttcagaccttttttctctgcacatataattgtgtatgtgtgtttaaaaatttttctgaacagcagtagcatcatattttatatacttttatacgtttatattttttctcaatttctgtatcactgacattcttctgtgtaattaatatgcatgtcttcttttttaagctgtgtatgtaccatcatataataagtccattccttttccctcccgatacaatgaattcgctttagcccagattttcaaatgttgggaaaacggcatctggcagctacatttctgattgcattcaagtcacaacttctctggtgaaatttgcaggttgtgttcagttgccccttatcttccctccaattgaaggacaggcagggactccaaacatttagcacgattgtctggacctgacttttagggttgaatcccagttccccactaatggactgtgtgacttctggcaggtgcttgtactgtctgtttcctttctgtgaaataggatatgataacgttacctacttcttgggttgctgtaaggagtaaatgagctgatgtataagaagttcttctctgctatatcttggtccatgtatgctgttatgttgccatccctgtcagtcatcatcaggccactgagtttgccaaaatacaaatggcttctcacaaaatggcactcatggcacatcactggttttgaaagatgggtcatggtggtcagtgtcatggcttcagttaaactggagagaaagaaattatacatatttactgtatttttatctgtaagggggcagagaggcacctgtacggtacactagtatatgcctagcagtttgattggcccacgagggatgcttcttggttgacttactttcttttactattttgactttcttttattatcaaaaacataaaatatttatagaagtggtctctagcattaaaattttatttattaatatatgtatacacacataatagaacattgtttttaaaagtctagaacttgtttttttccttcttctgcaaaataaaccattaaacattggtctttacatttccttatgttttatgattagcaacaccagtgaagtaaatagtaatatcttataaacttaggtgaaaggaaagtaacaaatgttgattttagttctgagagcatttcctgtgtcattcctgagaaagtagactgaatagccattttagaatcttaaatgccttcagcccaatagactctcctttttcatttcttgttctattttagtccacagtagtaaataacataaatttgccactgatggcagaagcaagaacattaaatgtatatttacacacacacacaccacacacacaacgatctactgtattgtttctaaaagaattcaaaggtttcgatttatgagataatactgatgtcaaactagtatcgttatttttatttttatttttatttttttttgagacggagtttgctcttgttgcccaggctgcagtgcaatgacacgtcttggctcaccgcaacctccacctctgggttcaagtgattctcctacctcagcctcccaagtagctgggattacaggcgcctgcaccacgcccagctcattttttgtatttttagtagagacggggtttcaacatgttgggcggctggtctttaactcctgacctcaggtgatctgccagcctcggcctcccaaagtgctggattacaggcatgagccaccatgcccggcccagttattttaaagaaaggctaaattgcaaaattttgctttttatattaaactcgttttacagcttttctttgtatataataggcaaacaagtaatatttttttattattttacagtaaattatattttgaattagattgttatttaatctttagcctttaacatgtaaagtttcttatacacacattaggctctcaaggtatcataagatgtggaaatattaacatcagtctaaatctagtatttaatgaaaacgagattaaaacaggtaagttcaaaaaagtttttaattgaaggaaggaaacaatctacatattatgagcttcatagacaactttttaaaaaaataaaacatttgcagaaaaatggagcagaaagtagaagctcacataactccctgctccctgccccagcttctcacgttgttgacatcttacatgagatgtaagatgttacaattaaagaatcagtattggtacattgttactaactgaagtccatatagatgcagattttctgagttcttacctaaggtgccttctgtggtccaagctcccacagacatttagttacgtctctctggtctcctcttgcctgcgactgtttctcctcctttgctgtctgtaatggatatcattttttataagcactcactattgacccggccttgaaccaaaccgtaacaattctttgtccttaaaaagtttgcattctaataggaagcttacaatctactttaaaatttaattttaaggaagaattgatgtttttagtgattaacatttaatatgacaatctgagatgtttagtctttgcataattagcaggaaaaattgaataaccgtttatagattattgcagcaacagagatattggctctctagtgtgttgatggtatgtctcttctttttccggagtattgttttcatatttgggaaaatgcttattttcaaaagagttaccctgtttacgcgagggtattgaattggagaaaagagtttctgtctgttgttgcctgtagggaaaatatcgtaaaattatatctcacatttaagtttttcttgtgattgaacaaagcagcttttaatacattgctgccttaagcagttgtatgaaaagtttaaaacattaagtatgtgacatatcagaaggagggtagcgtttgcaaatttgtgttgctgggttgttgctgatgataggtatttctgaagtcagaagtaacgaggctttgttgaaagccttggcattaaggcttgattgggggccaaacctgttaaaataggaaaattctaggaggaaaggtgttctgtggccatgggaatttgaacagttaaattatttttggcaaacatcatagctataactttatttttgccttaaagattatgtgttgcaagagtcctgttccacctgtgtcagcgggagggaatgctggcctttcctgacaaggactattccttaacagcagcaggggccagcagtggcggggagtaggagttattatggaaactgtgatttacttttgaaccgtttattggagcaaccctataacctttgaataataggctgtggaaagacaacgtcagtatccgtttagttaagtaagtggacattaatgaatcttccatacagaaattttgctgtgagctctattttcaactatcttggttaagctcttttaaaattacatttttcccccttcagtctcgttctccactggatgcatatttaaagtgagttccatagtgacatctggtggtggttttgaaatcctggagagtatgtttggaatgataaatttcttacttaataactccaaatttccggcttctttcggatttttcaggttattaacaactcactgtattctcgaggttggaaagctaggctttcattccttccgtaatgcttcattcagtaaagccgtgatttctgatggcactgctgagtggcacacgtaacaagcgtgtctcaactgtctcctgtgctccaaatctgcgtcatagcatcacgcagcagcatcacgaccgctctcctgcgtgtgcacggcaacctcctgacgggagtggcgacagagtttccctgtcacccctccacggctctgttgctcccggcatctggctggagggaatcctgcggaaggcctgggctgcgccctccctcctcacagcctgggcgcaggcaccttctggccgcatgctgtgtttgctttagaaaggtagaaggaggggagcgcagaggggaggagatgccgaagacaggagggagacccagagaagagtttgggggtggatatacataggtgcccaaaaaggtgaggtcgtgaatattgtaaatagaaagatacctgtaaaaactatagtttttgttggttccttttgtctccaggtgagtttataacccactatataaaaaagtacttattgaaagttgataggtagacattcaggataaagagaaatagacagggatagaggtttgagagtgaccacagtttgattcacatcagtgatgactggatgtctttagttttatttttgtttttctctgtgttaaaggcactaatagaagtcttcccaatggaaatgtgaaaatttgtttctctctatggaattgaggtaactgtaaagttacagaagaaatcaatctgtaatctgtaaatgccagtcgtggctttaggaaggctggtgaaagcatgatgaagtgtaggaacaagaactgctaatgacttaatgagtaaaggagcttcggtcatacttggagacagctggtgtgtcactccctgcagaaaccaggactccctaaagaatggtttggatcgtgatgaacccctgattaaggaagtccttcactctggattcgaactacacctgtttagcttcttggagttggacaaatcatttcaacgttctttaagaacagggagttgcactggagggttttgaaggcgttcccagtctaatgcttgattttgagatgcgaaggctagctctacccctggtctttctttgcacattatctagactctcactcagccacctggaccttcgtcttgcctctgattcaagatgggaagcttcggggttttgacctagagtctcgggctagtgccataggtccactttggaagtttctgcccagggttcttgaggagtgatcatgcaactgggctgacagattaaaaagcggaaaacaaaataacttggcacgcttaagcttccttccacccactttgtgcagtgcctataatagcgcctaggtactgaaccccaaactctgagcggaatcctcagatcgtctcccgtctgttgtcctgcatgcatgaggaagaccttccttccacactgggaaactccttgtggcctttcctcatggttatagccccaccaggtcccagcacctttggtgtccgacagtgttgctgttgattgatagtggcaacagcccaccgtcagtggagaagaccctgaggcctggagtcagactgtccggctcagctccggatcccacagttagctgttgaccctggccttgtttcctcatcactccagggcttaagcaagtttcttatggatctaagcttctctttcctcatgtgtaaagctgggatgaaaatcatgcaacttcctgttctttcaatgatttaatgcacataaagcatctagtgacgtgattggtggacatgaggatctgaggattttggttagaagataagattcttcggtgtgccctcctctccctttggcgttgaaatttactttatagttctccgtaagttgtattcagtgattttttatcttacaaaaggtaataattaaaatgcatcgaagcagaagcttatctcagcaatcacgataggcattaaaaagtacacagtcatgaattcatgaaataggaacatccagcatctcactcattcatactactattttaattgcgaattacacaatctccgatatttgaatagagtcgctttgttgcccagtcttaacctttagtaatatccgtagattaccggggaggccgacaatcccctcctgaggacatgactgtcccccaccccctggttgtacagctgatgggtcggtggggaccagcagtgccatctcagaattgcacactgcagtctggacgcttacggcccgaactagaaataaggacgacggaaaaatcatagctgtttctatctgtaattgcaaacctcagatgtgagggtgaatacttccatttcataattcttttttcccttgagattagagaaagctattgtgtatgaggaacatttaatacattcctgctgaatactgacatgtagaacaggtggatgaaataggaatttgactcatctttcccaaattaccacattaagttttgtttactcttttgtcataacagcgtaggactgacaaggatattgctggcgctgaagatgagatttgtggtattcacactccgctctgccattcactgtggccctgggaaagtgcctcatttctctcaatctgagtttttcttagtgaaatggagttaatagcatcacatatctaggcaggttggatgtaaagattatatagataatgcatgtaagacacttatcacagggcctggcatttagtaaacactgagcaaatgtttctgtaattatcactgtttgtaaatgcctctagtcacatttagaggggcacattttaaacagtagatggaagcatgaattgttggaggattagaactcaaaagaggtagataaaacaccacgtacctgtcttcttgagattttctaataatacttcacctgtcaagtgaattttttgcattttaatgaagtagcagcacacaggaggagttgtgtacattttgttaatgtgtatcctcccggagagaacattctgttatcccctgacgtctttgtatctgtggatagatgtgtgaatcagaggaactgggaaaggttattatttgagcctacagacagatataattttgctatttagcagaccagttgagtgtgtgtgcattatgcttgggttagagaacagggaagcattttgagttcatcttcagttgtctgctgtacggaggaaccagttagctcatttttatttgttctgaggtttattttattttatttcattttttttttttactatcctttaagttctaggtacatgtgcacaatgtgcaggtttgttacatatgtatacatgtgccatgttggtgtgcttacccattaactcatcatttacattaggtatatctcctaatgctatccctcccccctcccccaccccacgacaggccccggtgtgtgatgttccccaccctgtgtccatgtgttctcatgttcaattcccacctgtgagtgagaacatgcagtatttggttttttgtccttgcgatatttgctgagaacgatggtttccagcttcatccatgtctctacaaaggacatgaactcatcttttttatggctgcctagtattccatggtgtgtaggtgccacattttcttaatccggttatcactgatggacatttgggttggttccaagtctttgctattgtgaatagtgccgcaaaaaccaaaagcaatggcaacaaaagccaaaattgacaaatgggatctaattaaactaaaagcttctgcacagcaaaagaaactaccatcagagtgaagaggcaacctacagaatgggaaaaatttttgccatctactcatctgaccaagggctaatatccagaatctacaaagaactaaacaaatttacaagaaaaaaacaaccccatcaaaaagtggctgaaggatatgaacagaacttctcaaaagaagacatttatgcagccaacagacacatgaaaaaatgctcatcatcatggccatcagagaaatgcaaatcaaaaccacaatgagataccatctcacaccagttagatggtgatcattaaaaagtcaggaaacaacaggtgctggagaggatgtggagaaataggacactttaacactgttggtgggactgtaaactagttcaaccattgtggaagacagtgtgggattcctcagggatctagaactagaaataccatttggttctgaggtttcttccatgttttagaagcagtattataccccctttctgaaggttcagtatgaaataatgaagcaataacaatcattgtaatgcttctgaatggcaataaagattcattttatgataatttcacattttattagctaagttttctattttcaagttgtgagtccttttgggagtattagatataattatattcattcaaaaaatgagtttttctgatattaacctcgaataagttaatatttaatttctgtgatcaaaattacgaattgcaacagtgtatttttctcaaccaaatgtttcattgctggcataggtaaaattggtaattggttatttttctcacagtagtttgcgtttaacgggaaattcagtgattctagagcttcagcatttccagagtccagcctgtaccatggtgtagaagacactgaaagtatctttagtcccgagtgatcaatccatgagaaaaagtgcagtgatatgttttggtagacaaagggcgagattgcaccattgaataaaaaggtgggacttgccaaagagaatggatatttctacttcttatccccagaggaggtaaatcctggcttgaagttaagtttgactggtttcagtggctggaccaaaacattacagatactctaaccctcttctttgtaatatataatttcatctcttgctagttgacttactaagaaatgtatcctagtttgggtcccattgaggacttttctataccaaccctgattaagatacttagatatttcacttgtgtatttatacgttattgtgctttgtgtaaggtgctgcggatactggtatttaagaatgatgtggctctgcccttttggagtttatagtgtagtttatatttttatagcatgctggttgtcttccatttgtttgaggcgattgaaagaaataaaaggacctcaacactcaggagatctgagcagcccttattgtggactttgaaggttgcagtttctttccttagccactgtgagaaggggtggtgtgcagaccgagctttctggaggatgctgctcctgcctttttccttagacagtggccccacagggatgcagtgtggggagcgggggtgctggactgtggggtctcagatctgggcctggctctggtgttgtccctgtcttcctgagtagcctccaggaaagtcagcacgtctctcaccaactataaactttacctatggaaaaatgaagtgttgggccattagatgatctcttatgctcacctattttgagacttcagtgagataatatttttaaagtgctccatttagtgccgacacctgattctaataacaaatacttttatagcctatattatgtgccaagtgttctaacattatatgcatgttagttgaatatactattattgtctctattttagaagaaaggaagcgagtcacagaaaggctggttaacctgctcaaggttatgcacctagtaagagacatataagctctcagtaagccgtagttgttgacactttctgaagctggcagttttggtcgttgatggctgctttacgcttttcttttttctctctaggtgtcatagagacgtcagatcgactggacgtgaatcgacctcccattattggctaacagtctttgcaaccgatcagggtgtcgtgccctttcatcgttcatagagatctacatagaggttgaggatgtcaatgacaatgcaccacaacatcagagcctgtttattacccagaaatcatggaaaattctcctaaagatgtatctgtgtccagatcgaggcatttgatccagattcgagctctaatgacaagctcatgtacaaaatacaagtggaaatccacaaggattcttttcaatacatcctaaaacaggtatgtgttaatatgctataggaaatgtttatgcttatgcttttctgttagggggaaaagtaagaattagcattatctgttacatacttttgtttcttgataaattgttttccttttgaattattcaaaatagcctttattttggataaaaatttagcataaccgggcacagtggctcacgcctgtaatccagcactttgggaggccgaggcaggcagatcacgaggtcaggagatcgagaccatcctgctaacatggtgaaaccccatctctagtaaaagtacaaaaaattagctgggcgtggtggcggcgcctgtagtcccagctactccagaggctgaggcaggagaatggcgtgaacccaggggcggagcttgcagtgagccgagatggtgccactgcactccagcctgggcgacagagtgaactccatctcaaaaaaaaaaaaattagcttaaatgtgctttttaaactttgagtttgctttataaagctattttacgattatgctcattagtagggtttcactttcaggttaaaaagcaacattgttatttcagtaatagctcctaaattagtgatatatcttaaacttacagcaaatctactgctgctaagaatttgaattgtcctaagtcggctttttgtaaagagtattaaaaagtttatttcacagttggctagttttttaatgttttaagtgtttcctatagagcagtgcgtatctgcaggtggtaagggattgggattgaacagttttcagattggaagtggttacttcctgaagtgacaccccaggccttttgcttctaatatttttttccatcgatgtctgtgacgacttccctgcttccaagaagatagctccatgacctcaaaatcctcctccgaaattttttaaacttctaatctttgttcctttactgcacaagtggtgactgcgttcaccctccttgtaaataaagcaaaagtgagctaagaactaagtactgaaaaattaaaggcattgtcaaacaaagagaaaagtcagaggtatataagaattgtgaggatgaatttggagtccagaatgtattatgcctctctagtggcggtcccagacctccagagagagaaatctagaagtaaaagcctgattgacacaatgtgagtgtgaacaaaaaccctcaaagagatgttttcctaccctcttccaaacctcaacaatcatcatcacagaagacttctgggaccaagtgtgtgtttggggggcggccggggggcgggggggaggatttcctacacaccaagcagcggacaccttgggagtccctcattcaattctgacatttttttacctggagacagcctcagattctgcaggttaagggtcagttcccaagagtgttcacttcttcccaccagttgcaagccgaggcctctgaaactctgacggaccagctccaagcgagggttcccataacctctcttcaagcccaggcctccgaactcctgacccaccagctccaagtgacggttcccatgacctctctttgggttctgttacttattggagcggctcacagaacccagggaaacacttaacatttacctgtttattacagagatattttaaaggatgcaaataaacagccagatgaagagatacacaggggcaaagtctgcagggtcccacgcacaggcatttctgtcccggtagagtcagggtgtaccaccctcccggccctggatgagttcttgttcaccttcccgtagcctccacgtgttcagcggtgagaaactcgaactctgctttcttgggccttttatggagacttcattgcctaggcatgattgacgcacgacagccatgtcaacatgtggttgacaaaggcctgtctcttgagattgttcttggcctcgtctgcagcgtttccgcctccaggatatggagcgggaccctctctggaatgaggggctttgacacacagtcagattggagtcctgccttggcaggtgaaaggagagtggcaggtggccggagagagattctgtttcctgaggcaaaaagtgccacaacattataaccaaagactaacggggttctgggagttaacgagccaggaaccatggacagaaacaaatatgtacccctcccacaacacacgtatatgtcatatctcaggtggcaattcaagaccagaactacccctatagaatttgtttgatgaattagactaagcagtgttttcaattttcttgtgtcttctgtctctttttagattagagtaagtcctctgtgaagagatagatgagcaagcaagaaatatcctttggatatctgagcacatggcataggtctgggcataatatatgtttgaggagtaggaggagaagaaactgaggagattatatagcttagcattgctgtggggagccttgaaaacccttggtcttcctgggaccccagaaatgatgatgtgtctgctatggtgttatgtcttgttgtagaacatgattaatatggcattgcctctcccttttaaatctctctattctgacaactctaaaaaaaggtgtttgcagagatgtctgtgctgttgtcttcagaaggaataaaccctctccagtgtccacagccacaccccagccccggcgggagcacaggcactccgctggcagggcggcagaggaaattcagtgcaatgcacacagaggctttctttccttatgagttgaagtcaggtatagtggaggataccatagttagtacacagcagtatttgttgtgaagtatgttaaaaacttgtggttagtaaagaagtctcaacattccacagatcacctaaagtctctgaagatgaagacagtattttagcatggaattattaaataatatagtaaatatagcttcattagatctgttctagatgcttctcttcccccacctcagcagaaagttggggtgtgatcctcagggcctgagtacacatgcctcgtcttcttacaacctttaaagcagactgttcccaggtaggtcagttcatggcggcctgattgtgaaggctgatgaaagtccgtccggtaggaaatagtgcttggagtcactgacccatctcgccacctggagaccctaaatcgtgttacttaatgattaacggtgagcaaggaaatcactgggctggaaatccagagatccggaccatagtgaggccttcccctgggatcttggggcgaactgacttccaggtccttcgattttgtgattcatggtgtttcgtcccctgttgaggctcgtgtgtgtagagtgcaggagcgcccagcatcgttcaggggacggtgccacagccggcttgtgtgtgtagagtgcaggagcacccagggtcgttcaggggacggtgccacagccggcttgtgtgtgtagagtgcaggagcacccagggtcgttcaggggacggtgccacagccggattgtgtgtgtaaagtgcaggagcacccagggttgttcaggggacggtgccacagccggcttgtgtgtgtagagtgcaggagcgcccagcgtcgttcaggggacggtgccacagccggcttgtgtgtgtagagtgcaggagcgcccagggttgttcaggggacagtgccacagcgggcttgtgtgtgtagagtgcaggagcgcccagcgtcgttcaggggacggtgccacagccgcttcctcttgcgggtgttacggttgctctgttaatgaatgtcagacatcaagaatctagtagactgataaacttgtgcctttggataaacacatttgctagaataagtgggcccacttgtttcttagaaacatgaatttgggaccctggtgattatcctaaacgccagcagctagagaatacctacagttatcatcatttaaagcatttgtttatgcatcaagacagtcatgggaggctgaatgccagggatgcattttgagaaacgtgtcatcaggcgatttgtcgttgtgtggacaacgtagagtgtacttacccaaacctagatggtctagcctactaacacccaggctgtatgggatggtctattctagtctatagacctgtatgccgtgatcctgaccgaacactgcaggcagttgtaacacatttgtgtatccaaacatagctaaatgtagaaaggtgcagtaaaaatgtggtattaatctttcacaaccacggtcgtatgtgcggttcgatgtatatgcagcccgtggttaactgacacgtcgttatgcagtgcgtggccgtgtttatttccgaactatgaaatttttttaccaaatctttgaaagttcgtcatctacaaaagtgaaataccaagaagaacagatgtgtgcagcagtgtggcacaggctctcacgggtccggtggagggtggcaggggccctcacgggtccggtggaagtgggaaactggcagtggttatgttgggagatgagccccttggaacgggtactgggctgattgtgaagatggtaacaatagattgatgagaggaggtaggagatgttttcatgtcggcgacaatttgaaggaatggtgagttggagacaagaaataagtgtatgggagacggctaccctcagtggaaaacctcgaatgccagaatagggttaaagagaatatttgttatttttattaataaaagtgacctctttttgagtcagtaaaactgccttgcaacattttggataaacttaaataaaagtctttttggaaaagagggagcatctcctcaatatctttttctccttccccttttgtcatagtgtaacaaaatattttaaagtcacaacaagaaagctttctaggagtgggtttagtgagtgagcttatgaattttgtgtctaaacaacaagtttgagtgaacttttttgaatgttttttctcttcaaggtttttgtgttaattatggtgccaagaactgtctgtctgcatttcagacattcttattatattgtttgaagtaggggggcagtgggttttcatttttaggagatacaagtgaaagaccgcatccatttctttttgtgatatatgcacttttgttgacattgctaatttttataacattttttgtttactgtgtccatcatcagttacagggtaaatgtgcttcttttaacttaagttgagcacttctcaaggtggaagagagacaggagcatagaactcagattggagccttggcagctgcagccctgcaaacaaaagcatcacagctttgtggtgtgtcaaggacagagaagaaagggagtccaaacaaaagagactagtgtgagcttctcatgactcattattcacgaacaacctcgggaatcgacaccacccttgcaaagagtctttttagttaaagttattgctttgaacttggggggttgatatgcaacttacaattggcatttattaataattttgaagtgttacttttagacagtgtgtcctttagaagagaccatggtcttgctctcttatctgtatgtttgatatttttccgtttttgctacaaaccaagtattgatctttatttttaaaaagcttttttgaggtgtaatcacttacagcaaattgcacatatttaaagtctacaatttgataagctttcacatagctttacacctgagaaaacatcaccactatcaggcagtgaccacacccatcattcccaaaggctcctcacacttctctgtattccccctcccaaccctcccacctccatctctagtcaaatctggtgtgctttctagcactaaataatagtttgcatttcctggaattttatcttggtgactcacatggcatatactctttttggtaaggcttcttatacttcgcatgtttattttgagctcatgcatgttttggcgtgtatcaagactacgtttcttttcattgctgtgtatccttttatagatagattaatattataatttgtttatccactcacctagtaataggcatttgtatgctgccagtttttggcagtttgtaaatccgctgtgaacattgagtacaagcctttctgtgacacatacttccatttctcttggacatcacataggggtgcatagctgtctggaaactgctcaaggcagaaagctgctgcgatcgtgggtgtcccctcatctgtttctctcagggatcttgtctttctttgcctgatgtctagtgtcctttcaactgccagtgcattcattttgtctcttcttggtggttttatgttaaagcataaatctgatcccttactagaagtggaaggtcactattgcttttaaatcagaaaaagatgcctttttaagtttagaagtgccatcaatatgttgtactgtaaacacctcctttaataaacagtgaatcttcttaaccagggtttctgtgtctggagtaaaaactgaatttctaggtttattttaaatcgaaacttagcaatatcctggtttgtttctggagtttgtggaaatacagatatgtatgcactttttgtccctcccaaattgtctgttgtgttgtacccagtagccggaatggcacttctcagtcctccttccccaggtaccttcatcatcagtttaccctgctcagcaaggccggaaggcagatgtgtgtttgtgacgtggtttgtgatgtatgtgtatgtgtgggtagcacacctcataaattctatcacttgttttaatgggtaatgcaatcacatggcacaacgtgcaaatagtacaggaagatacccagtcaggtttactttcacccagttctccagacactccgttcccttccttagtatattaactctctttcttattttctgtatcctgaatgctgtggcatctgggccctcattgagtggggaaggacgccccttccaggactcgggatagcagatgactggtgcaggaccgtgcttttcatatgcagctgaccagtccagagtcccactccacaccaccatctgtgtcacgcccaagtcatatcaagccagtgctagacaactggggacagctatgccccagagcctttgaaattacttaaaccgccagtcctgagcgtctcaccttgcctttctgtgagatcctcagtcaagctttcccggtccttccacctccagaccaaccctggcatggtcccgtatggcccagcacggccttcggccttgccaccttcagtggcggtggtatggcctcctcttggggaagtaccaaactgcctttgaggtactttcaggtactggcggtcgtacctgatctgttgcctcaccatacctgaataataaatctacttagaggcaactagtgtttgcattttctttcacttgtatataagcaagaaaaatatgttggttttttcctcatctttttatacagatagcatactgtatacatggatatgatcttgggtttttccataacagtattggatgctgtgcttttaagagcaccttggctggggtggtggctcgtgcctgtaatcccagcacttcgggaggctgaggcttgtggatcacttgggtcaggagttcgagaccagcttggccaacatggcaaaaccccatgtctgctaaaaacaaaattagctgggtgtggtggtgcacacctgtaatcccagctacttgggaggctgaggcagagaatagcttgaacccaggaggcagaggttgcagcgagccgagatcactccactgcacccaacctaggcaacagtgagattgcatctcaaaaaaaaaaaaaatcaccttattgtggtactgatgaacttgccacattattataggaatatatgtgcatatccatgtacctttcacttccatttcactggtctactgattttatctaaccaatgtttactttttacctcttctcatcatcttcctctttgagaacaaatacagtaagaaagaaatttatttatgactaaaaataatttatcagaaaagtttagtagttaatggtacagggcatcctctttgactatatatgtattttgtgatttctgtgtgtctatatttgcatcttaaaaggttttaggctctttgacagctctacctgtatttctgtcttcctgagattttaaatacataatgcaatcacatagtacacattcaatatgtatataccataaaaacctcatttgataaatagtgaatcttcttaatggagttttgtgttttgagtttgtttcagcttaatgtttcttaggttttccttcctccatcctgagagtgaagttttttttgtttttttttttgtttttcgagacagtgtatcactctgtcgtcaggctggagtgcagtgatgccatcttggctcactgcagcctcaaactcctctgcccaattcttccttcctcggtctcctgaatagctgggatcacagacctgcaccaccacgaccagtagtttttatattttttgtagaggcaggggtctcaccgtgttgctcaggctggtctccacttctgatctcaaacaatcctcccatcttggcctcccaaagtgggatttttataggcatagccactgcgcccaacctgtagagtaaaaatttcatgtattttggagagtgatccttaccaaaatcccatctcattattgtggagcacattgcactgttagaatcttgctggtcctgcggtccatcagctgtctcatgcctgttcccttggagagctgagcttgaaggagatagcccagggaaaccagcaaagcctaattttccttgttttgcccctttctgtctcattctctgaatctttttttataccactcttccacccgtctactgtgtcttgccatcacttttggataggctggaacagaactttcgttaggagtcagaggaacattgacaagtgtgtctcatctattagagcagcttccacagacttcatctttacaagagccctgtgagatggtgactacagatacaatagcctgctgtgctccttatttacattttcttcattttacaaataatctaagacttccagaggtcagagctaccagaggtcaggcaatgtgaatttcctggctgccgcttctcagtcatggtgccactcccagtccctgtgcctttgcatttgggtgtaaatgtggttgtggagcagtttttctgtctcttatctactctttgcattgagggactctgtttcatataatagttgttttcaggctaatcttattcctatggtgccatcagaccaaaaatgggaaacttttaagtacactagatttttaaacttagttttatgaagcatgtaccgcaggggtcatcaaactgttctataaagggccacacggggcttttgggtttgtgggccatacagtctctgtcacaccaccagccgtgtcactgtagcccagaagctgctgtagatgatacggaaatgagtgagcaccgtgtgttccagtaaaactttgtaaataaacgaaataaattcaataaaatttgaattttctcccttttcatgtatcacaaaagtttttttcaaccatttaaaaatgcaaaagccattcttactagccagccacacaaaaacaagctactgtgctttcctgactcctgatgagtggacgttttactggtgggactagttaaacaatttcgttgattgctgatttttaaaattattttgagggatagacttttatatttctgaagtaaaaattgaatccctcccgttgctctaagcaaggtgcttagaaaggatgtttgtatttcacttctcttggttgttaataacaaaattattcttaaatagagcaattagagtatcagtatcaaggttgagatctcagatacgattttgcaagtggttagtagactgttagatctcttctacattgggaagtaattgtttctcattagaagaaaattttcctagattttgaggttttcctactttttctgtgttgatgtgtcctgttaagtttcagagctcccaatttcagctcaaacagttggctctaagtatacttagcaggtctttacatctcccccattttgtttattctcttattctgtgtcgacatgttatactcaaattactagtttccatttcatatgctttttagaggacggcgttatacagtgttctgttttttattccttctttacatgtaaaatcctgtatttagtatagaattattttatgtttactataggaatgtgatttgtgattgcagactgggcagcgatgtatagtttatgtgtggtaatccctaaacacgcagtaaagttacaaaatggtagaatagctggtaggtatactgggtgctcatcatggttagtccagtaacactttacaactatttttttctgaaccagagtaaatggcattttatgtggctggaacgaatactgaacaaactgcaataggaaatagctaaagctgcaaacaactccaggggtttccggtaacatttgatagctgcaaaggaaggaaaggacgggccagtcgcattcaatggcaggaattcatttaaaaaaaaattacctatttgcagtctttttaccaagatcgcagatattttaaggaggaatctgtagatttttttcctatctctttctcatgctcattttattttataaaataagtgaagtatatcatccctaaagtttgcaagaagtcaaatgttatcagtacatttctgccgatgttgatgatgacaaactttttcctccgcaaattggttaactgaatctttgtgataaattctgtcagcatttggtttttctatagctgctgaatattattgctaaaattatagttaagattttgcatttgggtgcctgagattagtctttttatgtcaaatgatgttaaccttataaaatgggttgtgtaccctatcctcttcttctgaccctgctattctgacatttataggatcactgaaggcaattccctgtaaattgagttttgctgtcgatctatgttttaatgccatcaattttcaacaagaaacagctagtaaggtagaattgaaagcaaagagacgtctgaagactagggtatggggtccctgtatgactccccatgtgactttagatagtcgtttgatccattttattagtgttttctttggaactctgaaagtttgaactaaatagttctgagctgctttccagcctcgccagtctatgaatagaattccatttttggctccagcctaatcctgccggcaccagtacttcagggacaaacaatagctgctgagacggccacactgccgaaagagcgcgcagccggctgtagtgacgtgtggtcttaggacaccacctgagtaagacggtgcggtgctgcggagatctccgagctcacagtccagagctctgaggggctggtgctgagtgataaagtgaaggagaagctgcgtgtttgctcgtggccagcaaggcaatcttgttttgcagaagcggaggacgtgacgcctccctgccggtggactagtcggcttgtcggtctgcatgttcagtgttggctctggtgtgtgtttcggggggatccagtgttggctcaggccttatgggccaggaccaccttcattcattattgtatccaccacagaaccaggcgtgatctcatgaaagatttttaaaagcagccacatttgaaggattttccctttcacccattggagaggaggcatagcagttcacacagacaaatgctgcccttgatgtagtttctgtcactccgctcacttgcgccttctgtccacccattgtacagctctcaggactgtgccatgatctctagtcacatacacagctttgttctggggccgtttcattttatttaagctggttgggtacaatccgtagactagaatgttccatggatgacatgtttacaaagggacagtcaggtgctattggagttccacagttacagtctgttatttctgtagctcatggtgctttattaatttattttaataaatttattattaataaataaatttagtaattatttgttaattattaatttatgataataatgaagcatcaaataatttatcaattattaataataaataaattatttaataaagataaattatttaataatagtaaataaattatttaattatttaatacttcattgtaaaatcaaaataatgaccaattgtgttgccctctcttttccgtgcagttggttgaccctggacagtggtgttgccctctctgttttccatgcatctggttggtccctgtagttctttggtacttacctaactcagagcaagctctctttcaacactgaaccatggacatttaaaacaattttaggagcccaagatttgtaacacatgtcctgtaaagttctaaagcacttttacttaaactctgacctctcatatcttccctatttatgtaatttatgttcatttttcctggtattagcctttttactgttctttcttagctgctgtataagagaagcaagaggtacggttaaaatcaaaggacagtttgggtaaacacagggtgagcacaggtaagtttttctgactaatgataaattaggcaaattagttttgtaaaaaaaattttgattaacttattgtaccctgaggcccagttgctggtgaagtgaactcttgaggacagagaggctattttgctttactcagaatcaagagtctgttctgtcttggtccttagttgaaacagctttagagttggaacttttgtgtgtacaggcatgaagctagaatgtataattattaatagagttactaagtcaatatttagggattttttttctgttatggagaggaaagaatatgagaaataatatactcagaactgatgtaaatttgtgtcatattttgtatattcataactgaaaacaaaagacttagctgagttgtggtctcagccagagatgttaaggaagtcccattccagagccgaggcatcctgctctctcctctcctgagggaaagcatgactccacttgggaattttgtttcatcccagatcacctttgggctgagttacttgtttaatcctctgctttttgtctcgtgtgtagagtgataagcctaccagccataaaacatttcaagtgaagacactaacaaaatacagaaggtaataaaagtggtttctctgaataatggaattgttcaccagtgttacccaattcttttagaaaatattttttcgtactttcatttgctatccaaataaaaaggtgtattagtatgtatatccagactcatcaattgtatatgttaaacatatgtagtttttggtatatcagttatacctcaataaagccataatttttttaaaaaaggtttatttccctaaggctactttccataaatttaaacgacagagtggattctgtcgcggttctggaggccaggagtttgaattccaggtgccgtgagggcctgctccctctgaaagcgctaaggaaggacctatcctcgctcctcccagtctccaggaaccgctggcttgtgacggaaccactccagtctctgcatctgtcatcagacacctttcttcccgggtctctgactcaaatctcctctacctttctcttaaaaagactcttgctattgaatttgggtccaccataaatccaaggtggtctcatcttgaggttcttaattacatcttcagggagcttatccacatcagttcacactcacagcttccagggttgtatgtatcttttgggcagggccaccattcaatccaccacaaaggtatttccaagaagacggaaaatatgctgttcaatgaaatgtatatagccatttagattcctcttaatttttttaatgttgtaaagactacattcatttaacttttgttctaacaggctttaatgatttggtcggtagttgcagacttgtcagaagattctgggtgatgttttaggacttaataagcagttgaagaacagatggaatcttcagtgggctctcccggccacttctttgttgcattttttgcaatgttaattatgcttcttatgtacttaagaaccatacttgagaaatactgtgtatttcttatatgtccatagtcctatttgtttctctgtatctcaaatagtattttaaagaaatagataatatgctttgttccagaaatgtccagtagtaattattataatgactgaaaacaaaactgttaaaaaaagagtgaattttttcaacttctgtcagcacctgtactgaggaggtcagcatgggatggaatcaccgggaaccttcatgagatggtacaggctgggtcctcatgagtggagagtgtgatttggtggctcggcatggagcgggaagaaggggggttggcattcacaccccatgatcccgatgcacaccttgcaggaaaaggctcgagcagtagagccttctgaacactttccttggtaggaaagtttccctgctgactcagaccttcaggaaattattccacatgcctagacctcatttcctcatgtttaaggtacaggatttgggctagagcatcgtgaaagaccctctggctttagcaaacttttttttacagtaagaggatacttagcacccgtgatccatttcattaaaaatttgctgcaatcaaaaacattagaaaaagtcatataggatatgccacttcaatatttctaaggagtttggttttttatatgtgtggccatatattagtgtatataaggcttaaaaaataattgatttggattttccagcctaagtttagttttcagccatcaaatatgtctatattttcactctgagtttaaaatgttttaatatttaaatttatttgagtaatatgcccattaaagattaaagatgccacaataaagtagtgtataaaatgaagttctcctgtctcctctcttccctcctctctctctcttccctccagctacctgttccatttcccaggagtagccagaagtaatatgtcaggttgaacgtgtcacagcttctgtgcacaggagtttgtgcacacattacatccgtacacaatatgcatgtctcatcagccccttgccttgctggtttttgtagtgctccttgtctaaaattacccaaacagtgtaagtttcacagtccgcccatgagtgtattacaggtgttttattgaattgtccttaatgttgctgattcttaagcacactgaatgtccctgggagcagtccctgcacagtcaggattgaagggtagaaatctaacttccggatcctggtagtaacaactcctgagaaattacactgaagaccctaaaacttaaactagacacttcctttaccaccaaaaatatatgattacagttcttaaacttagtatcaagtagaatatatgaaagtgtttcagagacacatcgggtgaaaatggtatgtatctgaagtgcgtgcctgcagtcaagggtttgtcagaaaatgctatgattaatacaacatcgtgagaaagggatggagcccagaggactccttcctgaaaaggagctgggcttggtggagagaacattctaatcctagaagaaagtgagatcactgataattttgttgtataatcattatacatattaaatatgattgatacatttagagttgtcatgtgaattaagagcttggactctggaatcagacagacttggggtcaaatctcagctttcatttagctggcaatgattttacttctctaaacctcagatatcttaaaaataaaggtaggtgtattggtagctcccttctagggttgctgtgagtatccagtgagagtgacgcatataaatgcctaccccagagctgggtcttgggaaacacataattagtggtggctaaaaagcgactgtgagaggacagtttaatattcacctctgccttttacatgtggtagttgtttccttaataaattgtatgcctttgaggacaagagccttgtcttaggctttcgtatatgtctctcaggtgacatttgggaacagcattctgagcagttgaatgacagtgcacagtgaacaagtggtgactgagatcgtaaacattatgacattactactgtttatgaacatagatttaatttagcacttttagtgcttaggaaaaagaagcaaaaacaaaacaaattagtagagtcatgattcccaagtcacagctaagcacagagcctcttgattggtacgtgttcaggtgaagtagtacacagcaattctaaagcaggcctcttcgtcgcccgctgagccaagtggagactcatagcaggaacggggagcaggagcatggcagggcagtatcagcacagtcaaaatctaggaaagtttacttttttttttttttctatgtaggtttaagacagatgtctacaaaaatttggatttagtaaatattttttgcttcaaattttaaccacagaaaaggattttgaatattgcagatgttaagtttttagttttgacaggcagcatttgaaattggagatgctataaaggatcagacatattggtgactatttaaatttaaattatttaaatttaaaattcagttctatggtgacattgctctgtttcaagtgcatagtggccacatgtggccaggtgctaccatattggacagtgcaattatagaacacacaaatcatcacagaaatttctgttggacagtgcttttctagaacggtatggctgtggttcatgaattattgtaaaataaaagggcggaaaggccaaaatcattgagggggtagaggaaaataatcagagtaaaaggaaggtatcgggtgaccagatttttacctttttccttgatctttttcccttcctgtgcttattctctagtagagtaattgaaaagtgtccaagtaaatttcctgccgggtgaggtgaacatagggctgcagagattccttcctttaagccaggaccctgtctttcagtgtggggtcatcgatgactcgtactacagattgcaagtcttgctctcttgttgcagttggacctgaatcctattcagaaatcctatttttttcctttctagctgccatctttcatgtgtgtgtgtgtgtgtgtgtgtgtgtgtgtgtgtatatatttttttttttttttttgtgagacagtctcactctgtaacctaagctcaattgcagtggtcgccctcagctcactgcaacctcggcttcccaggtccaagtgagtctcatgccttagcctccaagtagctgggattacaggtgcacgccaccacacccagctaatttttgaatttttagagagatggggtttctccatgttgaccaagctggtctcgaactcctagcctcaagtgattacctgccttggcctcccagagtgctgggattatgccatccatttttatccactgtgctgtgttgaaatttattttttacagaaccacagtcttcagtccctccctggtttctttcactttaatgtagacttactagatttattgaacccccaacttcaatactttgctaaatgacgtgagtaagcaacttaatctctctaagcctgtaaaaatggagatatcttcacatatttacaatcatatgtgaagatatacacatatacatatgtggatatatctcagttttttacaggcaatatatatatatatatatatatatatatatatatatatatatatgtaatgaagtatctataaagcataataccttggctaacaaactgtcaaaattgagtggcttgaaatagctgtcaaatttagtttagggttctgctgggcagttcttccgcccttgaaataactcataatttaggttctgccgggtgcttcttccactcttgtgcaggcttggctggtggccagctggtcctcgtggcctcactcacatgtcaggcaatggtggagcagcacgaatgactagaccacgtgtctctcttccaaccaagtccacacttttctggaacacagagttgctggcaagagccttcctctgcttcctgttttctgtgtgtagctcctgcactgtgttttctgtcagtgccctacaattatcctgtcttactgtttctcacatgtaaagtagtctttgccaacttctagccttcatctggtttcttgcaaacaagactgtcttatctccactttctgagtggacagtacaacacagtgactgaatgcattcatcgctccagctgtgtggaccatgtcacatgactgtcttcacctctagtcctttgatgttcacttttacgtctatctgcttcgcgaagtctactttatctcttaattttgagaagtttggagatggttttgttactgatttataagaaatgtcaaagagcacattttatattgaaacatagctgatctgacattctctctgttctaaatgaactcatctctaatgtctaagtggcgttgaaaggccatgagtggtttttaatgatgttcctcaagtgccaaaactttgttactgcattgtgcatacatttctggggtgaactggtaactgctcattggtagaatatactgtgtctgctgtctcagcccacctacatttatcatagttttattatatagatgcagtgtttttctggaccaaggaaagaaaaatttctagtttttcttcctttctattttaattatcagtgcttggcagaagaggaagatgaaacacaaagttacaaaaagaaaacagtgcatatacgtttttctgcttttgcctcttttatctcctaacttgcttttttggatctataaatgactaatgatgagtcattcctggttttttcgttacagtttatgaaagtcacagtcagagttcatggagtgttgaaatactataatacagcaaattacgcagtcaggtgtgataggagaaaaaaacgctcatctgagcctcaagagaacgaaatcctactcctggctttgttatgacttactagtggccttggaaaattttaacttctctttggttcaggcagctcaacttgtaatcttaaaggtttctgtctagttctgaagttctgtacagtttcctttaagtatatattttctgggatttggcaaaaaatattgcagatgagcacagatgtcgaaaatgaaagaagtgacatacttactaggacacttactacctactaggttaataacatgtagtgggtatatgggcagttgtactttagaattatgtttgaagtcgatgtttcaagtgggtgggggtggggggggatgaggagcaggagtgatgctcacagaggcgtgaatgagtgtgaacacagaacacaccggtagattgtcttgtatggccagagtgcagggggttcgggtagcgttccccggggtgtaggcactcagtgtggttgattgctgtaaggtaaagcgcacctcgaaaagacacccagaagcctagtattaaattacatcattaggaaattctgttttcattttgtatgaaaatcccacggaagccctaattttactgtaatttttcgcagagggggtgcatcacctggtgccaccccataggacactcatgcacggcctctctctggagatggcattagggaaaagcactacggcaccttgctaagattctttttgctaagtgttgtgaatttagaaagaaagtttgttgttgtttttgtttgtttttgtcagtctgaaatatcttacgtgttctccgcagaaaagtaaacccacctgcagggtttcttgcaggatcttgatttgtgaattatgcctcctgagtagaccggtgcgtccagcagagcttcctgccgtggggagcgcgttctccatctgccttgctccatgctgcgtcaccggcccctgggggctgccgtaccctggaaatttggcttagtgtgattgagaaatgaagtgtaaactttactgaattttaattaatttaaattccactggtctcaggaggctatggtgactgtatttgttagtggaagtctacatcttcgtcttctctctagtttacagttaatgtgagacaatctcgtcttcgtaaaagtaatacttctcctggtctacttcctgcctcatttctcttttcttccaggctcctccaaagtacgtcctccttaaaatcgtctgcctttggttctgggacacgaagcttctcttccagcagattgcttcctaggttgaagatcggcccgcattttctctaccgtttttataggcccactgttctctttagtattatgctcacttctgtggtgtggtctgagtcacacctgtctgtatgcccacagcttcttccctgcgcctcgggtcttgcttctaaatacccgcagggtgccgccagcccctagccacccatcgcagcacgtagcccccattgcagcacctagccacccatcgcagcacctggcacacgctgcctataaatatgtctaacgcattctctgttggctcacttatgggctgtggatttgtatcattttcaggtttaagtagtttatctctctcactctagcacatatttttaattctgctcattcatagttttaaaaattcacatgttcacacgtttaagtgtttcttgaggatgacggagagatagctatgtggcaagctatgcaagaaagacagccactgtcctcgtgagttttccagtacagaaaagaagctaatttttaaatgaggggctttaatactgtggagtaatattatgatagaagaaatattgaacttggagaatgcagcagcaggaacccacgccaggccctgcagtgagtttaaaagttaaacccgcttcagtttaaactgaagggtgaggcagtgactcaggctgaagtggaaagaaggggctaatattaccattcattgcattgggatgaaattaaagctccatctgagttaacgaggagaattaatttgaggagtatagaacatgcaaataatttcagacccaggaaggaggtgtcaggtagccttttggctttatgtggattttgtttttttttttttgacagagttttgcctgtcgcccaggctggagtgctgtggcgcaatctcggctcactgtggcctcctcttcccggttcaagcttttcttctgcctcagcctcctgagtagctgggattacaggtgtgtgccacatgtcagctaactttttgtatttttggtagagacagggtttcgccatgttggccaggcggtctcgaacctctgagctcaggtgatccgcctgcctcagcctcccaaagtgctgggatacaggtgtgagccaccatgcccagcctttttatgtggaattggtagtatggacacaggtcagctttccttagccttcttgtgtgctctaagtaaatcgtgaagtggggagttgtatttctcataagtatttgcgcagtgctgttggtgagtgattaagtgctctgcagaagaatactttttcctgggaacgtgtcaagctgctattccacgtgatgttaccatcaatcacaacttctggtggacacattacaataattagatgtgggactaatcaaggggctccttgtcgttcctaactatttacaaccacagttaggagaggatggtacatttttgattggggaaaaaaagagttaacttaaaaggtttttgactaatgaaaattaagcttgtgccacattcaagcgtcattttacacccgtaagcactgtgaagcatttccctttagcaccttttaatctatacctatgactgggaaaaccccagtgtggaggtatgatatagccttctgttgcccttgttaaaaagagacactgtttcgttgaattgtgaggaaaataatgttgatttagattcttagtaactacttaggaaaaaaacctttgaattaagtgaaaacacaagcctttcacttattgctgcagagaacatgttgaatatcccttaagtgatagttctgtgaaattagtaaagattatgggagaaaaaaattagattaataatgtctattcttaaatgtgaattatttaaggtatttccatatgagaaaaagccgcagcactgggaggagaacgttcagccctggtgattgtcctgccacacaggtccacctggttttaaggtcggaggtgcagatcatcctgcatgcacctgttcaccatcaaacagattggggacgacattttagtgcttaggggagttttgtttgtggttttggtgaagctaagaatacattttataaattgtaattgccttctagttccaaaatatgcagacagttgacagttattaaagttctcaagagaggtcaaaactcatagatattctagtttgataggaaattgttttctagaatacagaatttgaggatcattaattttcttttatgggaaattaaatggcaagattacctggaaaattacattactttttataacagttctttatttatgagagtggtaattcaaaggtaataaattagagttaacactttattttcaatagtccttattaatatattatagaagtcatttctgtcaactctcagttatctcttgagcagttaaaggagatggatagattgaaatcctggataacttcatctcacttttaaaaaatcttttctgacaaaatgtaattgaaaccactaacaaatagaaaatgtaactgatttgagtttttccactttcttactattgtcatttatccaatatgagtcattaaagtgagaaagtataaagtatgttgttgtttgagacaaaataaccgtacctggaaattaaatttctttagtaagaaatttctttcttcttttttcttgagaagaaatttgctcagacttttacaagagtatggttttgttttttattgtattttgagatggagtctcactttgttgcccaggctggagagcattggtgtgatctctgcacctccacctcccaggttcaagcaattctcctgcctcagcctcccaattagctgggattaagtcacgcgccaccatgcctggctaactttttgtagatacagggtttcatcatgttggcaggctggcctccaactcctgaccttaagtaatccacccccctgggcctcccaaagtgctggattaaggcatgagctaccgcacctggccaagagtgtgattttaattgcagtattttgaattgaccttattttgtgaggattaatgaactgttatcattttacaggtctcatcacaatacgtcaaggaagctagaccgagaacagcaagatgaacacatattagaggtaagtttttttttatctttaatacttaaagattcgtagttacaagtatcatgggaaagaacaatcttgtcccattaaccagtattcttagctattaatattttgttgtattaatattatttactggtgttaggaaaaaggaatataaggaaattgttaatgaatatagctcttgtcccctttatcctcaataccattcccagaatacacagccactgtcatgggccggattcagatctttgtatttatgcttgcgcacacacagggggcgaacagatctataaacagtgtcatgtggaattcattgcatttacataagtgatatttttctgtatacatctttttttccccttactattatgttttgagatatatttatgttggtatttatagatctgtttcaacctttttaactagaggtaattgtttccagattcatttttttgctcttaaacagttgcattatttttgcgttttaaacttgaattacttagtttgtgcttcttaaatacctcaaaagtaaaagtagattgaagtctcaatgtgctcttctagaaagttctaataaggcttctcattctcatggataatttacaatgcttttagtccttagaaaacccacagcttgttatcatgtattggtcacctggtttttggctatagtaaatacattgcagaaaaaggccgcgagtaatttggagagggaaggtggagcgtacatggacatcaggttgatgagatctctgggccgtgtcgtcaggaagcggctgagagacagcagaccgcagagaggggcgtagagacatctctctgtcccgtgtggaagactggtgttcttatcggagccagccttggaaaaggccacctgcctttgtttaattgagttatcagtgctttcttccactctaacagtataagtgacaaaattctaaactgtaacttttgaaaatttctttaatattgctgtttataatgctgcctgcttaatttcattttatccttggtcaaattttttaacgttgtcagtaaatacttagtttttatagttgtgcagtgtatgtgtgtgtgtgtggtgtgtgtgtgtgtgcattgggaactgggaataccctctggaaaaggtggtttcacagcacagtgctttccccattaggagctgcttcatgtattacatctgagtttttagttcataggtgtaaagttcgcttgaattcattttctttatgatagagcaaagttttgaattttcatttgtcactacaaggattgacagaaggggcaaatgcagtcactgacaaagataaacagatggaagataggagagcagtagttacactgacattttgctccagtcctttcaaatttcacataattgcatacgtcactccagagtcctcttttctccgtgaatatcaaaggctaggtggaacagataccagatatatagcactttgaaagtcatatttggacatggatgggaaataaatttcccttcaacatacataattagtgtatttttcagtagggtccttttggggtggtatattgagagccagtgctggcattgatttggctgtcttaaagatagtgtctccattacatgttgaagctgtgactagctactggttcttgaacccaaagttaggaacaatttggtgatgaatataaaaaacatagtgcttgcttgtatttctctttcttgtttttctaaagctcatatgcaactgatgaaaaggaaatgtttcgagagtttaaaattaaaatagtaatgttttattttgaaaagcttaggaaggtaaataatataaagcaactacttaaatacttttgacaggcaccatcggatatagtcacactttaataaacagggtttacaactgccagacttcagtctccttgacgtttttagtgttttggtaattcagttgggaagaaggtaggggtgtggataggggagaatagcattactaatgtcgttatatttaatgtgcccattgacgtaaacgtgaacatttgattaagggtgaaatggtctcttagggacatagaaacagtcatcagtgcagtcctcaagactcctgatattttttcctaaatagaatataagaatatatggatagtttacttaaaatgaaagtattttaccgaaaatcttatttaatgagttggtcttaaatttaaatgtttaggtccactctataaaaatctgtagaggaaaacagccaaaataaaatggtgattactggtattaaaagtgtactatttatttaacacatactttaaaatgacaatttagcatattttactgatgaagttaacatttttaacatgatatatggaaattttgtttttaagtatgtagagtgtgttgttttaagaagactctttaaatgtgtaaagcagaatcttcacgtatctcttccatggcctaaggtattaagtttttggtagcttaacatttgggtgaggttcactttccacttaaactaatcgagaagagagcctgcgtggtcaggaaggcgcgcaggggtgcagctgtttctttcttagcatgcccggccccctgactctctccctgtagagatgggaggtgctgcctcacctccttaagccctgttgttggaatgaagatctgctgtgtatgttgtcatcgtgccctgcaaaatgcgagctttacacacatgcggagtagcatgaggaagaagatgctcactttttatatagtattcttaacatgttaatctgttaactttaaaaaaacaggttactgtgacagacaatggtagccccccaaatcaaccattgcaagagtcattgtgaaaatccttgatgaaaatgacaacaacctcagtttctgcaaaagttctacaaaatcagactccctgagcgggaaaagccagaccggaaagaaatgccagacgggagccgctctatcacgtcatagccaccgacaaggatgagggcccaatgcagaaatctcctacagcatcgaagacgggaatgagcatggcaaatttttcatgaaccgaaaactggagtggtttcgtccaagaggttttcagcagctggagaatatgatatctttcagtgagttaagattgtagtactgtaatttttcatatgttgtgactataaaccttttttgtattttttctttagtaactttatttctattttgtaaacggctgaagtgtttgtgcctgctggccccattaggcaatgccggataacgtttgagaatcagggtgcttattgttttgttgaatgtggtcatgaaatcattgttcttctgtcaggcattccatacacagaatacaatgtgaaatgtttgaaattggctcagtttaagaccaaaccagtctgtgcttcattcattctgggttgtaactcctgatttgctgtttttaatcccctctgcccaaatgttgtagattaggcagttgacaatggtcgccctcaaaagtcatcaaccaccagactccatattgaatggactccaagcccaaaccgtccctggagcccatttcatttgaagaatcattttttacctttatgtgatggaaagtgaccccgttgctcacatgattggagtaatatctgtggagcctcctgcatacccctttggtttgacatcactggtaagcattccccctcattttcgttgtccgtatggttacactgaggagaacctgcatacggtttgatgagttttgggcacaagtcaggatttaaattgggaataagatcgacaggtggagaatttgctttcaactataatattttgattgcaaatttttcacaatatatagcatatgttaaacttgcttaaaataggtgctctattctacaagttattgatataaaaataaaattttgtaaaagtttgtcaaagagttacagacaaaagcttgaatgttttggtccagaagcacagcttcttactgtttatttattgatgcataaccttggcacattgttatttttattgatgcataacctatggcacattgttatttttagtgaattgattggaacatttaaagtaactatgcctgtgtgactgtcacatgtcaatatttaataggaataagcttacaaattttgattcataccagcttatggtacaaagttatggtaccagcttgggtttttagttttatattacctcattttcaacaggtaggaggattcattagattattcatcctccagtaaagtttacttgctaaagccatttcttcttcttatttgtcatgtagttagataagacattgaatgtaataccctattcaacgtattttttaaatttcacattagagttgcatcttagatttttttttattgtttcctcacattttagttacaagggtatttaagaaaagagtctctgttgcgattcatctctctgggggggactttatgtccatttttccccttcgccccttagtcatgctaacccgaagcccccaaaagttgcagctgatggacccagaccacgggcatgtcaggccaggccaggccttacctttggaactttcatgctaaatgctttggctttttaccaatttggtgattgtgtgaaattgatgtcatcagcacctgtgaaacccttacacatactttcaagggaaggggaaaaagagactattttcgtagttaacgatgctcaaaacctttgtttgctttctgttaacttttatcacatttccagatcaacaggctgctgctgtgcatacctgacctcgctgtgtaaccttgctgtgcttggacctggtttgattgattgcttttatctgtgcttgctttccatgcgcgcttgcttctttttggctgtgccaggagacacgcttgtagagaagttttttacatctttcagatgacttgtgacccgacctgtacagcagaaggtactgctgagatcacataatttgcctcagattatgagatctaaaataaaagccttgttttgttttgtttttttttacttttttatttccagtgactatcttccatcgctgttttttttttatagtgtgcgcatggtcacccatcccactcgccagcgtgttgccacgtaatgctcacctgctccgtggttttaggtttctcttaagacgtcgtgtgtgttgttttgtttcttggttagtttagtagtagaatttcatcatgacattaaacctctattttcatcccatttcattttattctaggtcgatggatttgaaaagagagttttatcaaaaatatttggataatattaatagatagaaacttttgtttcattaggctttgtgtttgtcaaaaatgagaaaaaaaattctttcaaatagtttatagtagccaggactaattaaagttaacgaccgctattttttttagagtaacattgatttttaatagctattttattaggtcaatttgctcaaagtatcagaaagtttgttagtaagtaagcttttaaatggcccagtgatggtatctactgagatacaaattgaagggaattcagaacccctgaaaaagcaaattgaaagtaactcattggcaatattagcaatgctttgttttcagagttgctttcttgctttctttcagttagttgcttcctggacaattaggttcactttgccttaacaagcattgtctttctaattggccactcttttctttcaaaatgtcctccttggaagctctttgctagtatattagaagatttttcagtgccattaagtatgaaaagccacagaataaactacagagtgttatcctgtgacctgtttttacttttttttcccaaattaggtggcaactacgacagtcacttcgatgtggacaagggaactggaaccatcatgttgccaaacctcttgatgcagaacagaagtcaaactacaacctcacagtcgaggctacgatggaaccaccactatcctcactcaggtaagtgaattactaatgacacacttgtcagagaggatggagataacgttctgacttaggggtccacgggcaatatgagcggtggattctgcctgtgagggtctaaaatcagaagtttacacacatgcacactaagaatttttatttaggaaagaaaattaattccatatcccaatttgggttttgcatataattaagcagttttgagattttgagagaagacttcaaaaaccaaaccaaaccaacgttataccatcaaaatcttcgattttacactcattttaaactatgttaacatcaagtacatcactgttgagaatgaattgttaaatcattttcagtaaaactggttaaagtgattaatcttctaaatcacttttttttggttcctcctggctatataaaataactaataaaattgttctaataattcctttaccaccttatttgttcctatctggtaattgagatggccagattatggggatttcaaacttaagtgttaaatcctgtaagtgaaatttaaattctgttctttcttattacttttctttggttctcaggtgggccgtttggagtgtacagaaggaatattcctagatagaagaagcatcctgaggttcaggagcaagcagagtgtcattcactcatttatttaccaagtatttgttgaacacttgtacatgccaggcaccattctggaaggtgaatagtaggaaacagaagaggcaacaatcttgcctcttggagcttacactgggatggcagaagctaaaggcttgtttataatctactgtggctaaatgaaaaagaaagaagttaaatgtcagagaacaaggtgcatctgagtttgaaatttctagcgttagattatcctgttttaagtactaagcaagacagatcatctgctaactcattagctgcattaaaagataaaaattatagtcggtgatgtcttttcgattaataaatgggtgataatttaaagccatttacaaaaatatttctttctccaaatgcttgtgatttttagtgatataaaattgatacatgtatgttatatgcttttggggtcattttgagattgtcttgtaaagttctagtatggtgtcaaaatttcaatttagttggtagctgttctcattctagagacagcaaaatctattgattttctctctttaaacataagcccttgtaaaattttagagcacaaaatgagaataaaaacatcataaattgtaataaatctaataggataattctgagagaagatttaaggggtataactgtagaccaattcacagaatcgactacccagaaatctaacaaaggagcttcataaacagtggagctgtccctctttgccaagcattctcattactaaagacctacgtctatgaataattaacagtgcacctctttcccaataattatatttttaattagtgagttaaaagtttagcatgaaatatcacgtgcaccaactaaaatccctataaaacccaggagtgtattctagttttctttcttggaaacacaaaatatcttaaatttcattgcttccttatacttctgtaacttatttttgggccattgtcataggctgtagatgctatcctaatcgcggcagagaaaggcagtcggactataagagaacagtagcccaggttgacctgttaaggtggggacaaagggaatgatttgtgtttagattatttttcctctttagctgagaacctggaatatgaatttgggtgggggcgggaggggggtgcagcagctgccacctggagaagagcacagaatcagctggacagtgagaggcaccaggatacagcggggatggattgaaaagcagaggatcagctgggcggcgagacactaggatactgtggggatggattgaaaagcagaggagtccctgggcagtgagacactaggataccgcggggatggattgaagagcagaggagtcagctggcggcgagagactaggataccgcaggaatgggttgaagagcacaggagtcagctgggagtgagacactagggtactgcagggatggattgaagagcagagggatcagctgggcagtggacactagcataccgcggggattgattgaagagcacaggaatcagctgggaggcgagacctacgataccatggggatggattgaagagcagaggagtcacctggacggtgagacactagataccgcggggatggattgaagagcagagcagtcagctgggcagtgagacactaggatccgcggggatggattgaagagcagaggagtcagctgggcagtgagacactaggataccgggggatggattgaagagcagagggatcagctgggagatgagacactaggatactgcgggatggattgaagagcagaggggtcagctgggaggtgagacactaggatacctcggggatgattggggcttggaagtaacactcagaagtcaacagagcagccattgtgtatccaggtcagggcagcagatgccgatttgagaaggtttaggtgagccgttggtgagtcaagcgggcagctccagcagaggtaggcggcaggacagtgggagaactgccagtgccctgcggaaacagccttctctggctttcctgtcctgcgtgtgtggcttaggatgctgaccgccattgattccatcacttggctttatcttgtatctccaggtaacttaccaaatccagttaccttttttttcttcattcaaacaactttgctttcatatcttctttaactttctctcgagcatcagcatcgggcctctggagcagatcacttggtttgaatcccggctccacctcttgtactcctttccagggcaaatagctgtaactctctgtgtgtccatgttctcatctacaaagtgggggtggtgtaatcgtccttttggaggtcttaggaaggttgatgaggtgacccgcagggtgcttgttctcacgttctgagagcctgtcacccagtaagcacgcagaaagccatagtcttgttgcacacagcactggtttgggctcttgtcccaccaacactcaattcaccttccagtcgccattctcatccctgccactcatgttggaagcgagtttcttctgaccaaaaggagctgtgtagtcccccacatcagttctggagtcgaggctctgcgtatttgactctgccttcttcttgctccttactgtatcacccctgagttccaagtcctctccagcctctgaaaggcaggatgttccgtccactgcttgccttcatgtcgttgacgcagcccttcctcatacttactcacctgccaacaaaaatgtacccaagaaagcattatctccttaagagctttctgaatatctcagccagtcctggactcttaaaaactttacatgataatatatgagacatggttaggctgtgcatgtgcgaacattgcctggtaagcctggtggctctatgagggcagagaccattgcatgctgatttacacccaggcaagcattgggcatggaaacgcacaatccgtgtgtttcaattgaattgcttgacttccagttctttctacttaataatgcttgagcttggagcaggattaaacttctctctcagtacccactacatgggaaaagtaatttttaaatttatagtggaaatgaatatgtatctaatctatggtaattgcctttatagccatcccttctggatcatcattgacctgtaaagtgaggcatctgtagttttaaaggtttacatagctttcacatgcaacctttccgtggttggtggatgcatctggaattcatacaaaatgtaatgttacgttttatttaactaaaacatcttgatattttggtcttctgtgagaacactgatgtagccctcatggaaggaaggcctctttcatggcctgcaccatgtggttgaccgctctgcctgggaccctggccccctgtgctgctggaccagcagatccctttgttccatatgcccccacgaagcgcagttttcttcttcttaactctaaagcatgttttataattggcagtgatttccgctgtgccaaatccatacgtctttcattatggaaattaatcctcttactgtcaaagttttgtttgtttctaatttagcttagaccaagtttcttaacatttgcttttttcctctaaaggtttttactttatgtagacatagtaagagagtttattttttcaatctattgactaaattggttttagggagtaaacatatttctacatagatgtaggtttatgatcacagaaatacagtgatttctaaacacatttcttatttttctttttacgtattaaaaaaacctatgatcaggggcttgggatgtcaaagatgagatgagaaatttggatagtgtaatcatctgtcttacctcagtgggttggtagttgcagataaaatctgatttaagaaattagtcttctataaatcctggtaaattgttatccgtacatgatgacctacagataccttctctgtggaggcgtaagagaagttaagcccacgtaaagacgtgcaagtgtgaaaatcaatacatattttgtcccagagttagttataagaatgcagaaaggcatcattatcttactcatatttagataagtaatataccaatgagaaatgttttaagaaagtatgattctaggtttttgttgcctttctcgtattttattttgccacagtatcgtttcatatacatgactttcgttcatggttctttaagtattaaaacattcataattggaaatatttatgagtcattttgtcatccattacaggtattcatcaaagtaatagacacaaatgaccacgtcctcagttttctacatcaaagtatgaagttgttattcctgaagatacagcgccagaacagaaattttgcaaatcagtgctgtggatcaggatgagaaaaacaaactaatctacacctgcagagcagtagagatccactgagtctcaagaaatttcgtcttgatcctgcaaccggtctctctatacttctgagaaactggatcatgaagctgttcaccagcacaccctcacggtatggtaggcgctctacccgctctcctcccaccatttggtcctgaggcctttgtgtgttcagcgtgatttttaattagttataaggaaagcaccaatgggattgataatgtgtcaattcttttaggtacgagatcaagatgtgcctgtaaaacgcaactttgcaaggattgtggtcaagtcagcgacacgaatgaccacgccccgtggttcaccgcttcctcctacaaagggcgggttatgaatcggcagccgttggctcagttgtgttgcaggtgacggctctggacaaggacaagggaaaaatgctgaagtgctgtactcgatcgagtcaggtacttttggagccttc

SEQ ID NO: 5005 - DNA, 41839 bp, Homo sapiens
caggccgcgcacacctggctaatttttgtactgttagtagagacagggtttcatcatgtggtcaggctggtctcaaactcctgaccttgtgatcctcccgcctcagcctcccaaagtgtgggattacaggcgtaagccactgcacctggctatttttttttttttttttttttgagaaggtctcactctggagtgcatggctcactgcagccttgacctcctgggctcaagcaatcttccacctcagcatctttagtagctgtgaccacaggcacacatcaacacacacccggctatttttcattttttgtagagatgaggttgttgcccaggctggtctcaaactcctgagctaggcaatcctactgccttggactcccaaagtgctgggattatgggtgtgcactaccacgccagccaaggcttagacattttagaatgaggcgatcctgatttcagttctaccagagtctgaccccactatgctgctgatgaagactggggacaaaggtgttgaatggtacaggaaacggagtcttaccagggtcatgctgagtgtacggcccatgacagcatggaacaggtcgtgtcagctgggccagacacaacaaaaaattcacagatgaaaaggtattcgcggcaggaattgctaggagggcgtagtgctggctgcggaagagggcctcaaatggatactgggagaggagggtaaagaagaaaaacagaagggatggaccccaacactgacttcccatggatatggctggaaatcagtaaacctgagtaataagagctaggcagacccttcgcatctatctaggtccggctgtctaagagcaagctgaatgggcactgaaaaggtgggggaacataggggtacaaaaaggcctacacccacctgctgttgctactcctgcatccacctcaacacctgcctctgactgcattcccctcatccagtctctcccctctgcatgcccttaagtcaatggttcccagctctttcacatcacagcaggctggagtgattggagaaggccactcccaagtctaaggggattagacagggcctgcaggttgggaagctctgccctgaggtctggccttccctccccaccgtgtcagagcctctttcgtgactgaagcttgttcctcctcataccctctgctctccgcgctggctgtgtgaggcaccaggatgggggcctcaagttcagtgggggagatgacagagccgcggttcctagggtgaaaatggtgttcctgctgcggagcgatggctttgagaagaatcgtaaatgggtcagagtcagggaaaacaatgagaccataactgggcccaaagactcactatctgggggaccccagacaggcagacgtggcctagccagccctctttcccagtactagggcccccgtgctgacatctgtgaatgggcttcagggtgtctctccctcccttgcaatcatatgcaaactatgtgtcaaaataatgtgtgcatctttctggggagggaggctatagctttcatcaattctaaaaggtttcagtcccataggaaaaggtaaggagcagtgcattggtggctggagcgaaagtcctcccactctcaaggcctggcatgagggttccccagtactaggatatcttttttgctgtatcttccacacccattagatcatctttctcagcgacttcctcatactaaggaagagaaaagagaactgataaccgtctcttcccacaacacaataaaatattccttgcccgggatgtcccctcctcccagtccatgtgcccaggaatacctctccctcctgaccttaccgcaccttcatgagccgccccaggtaagagcggtagtaagacaggtaaatcttgctcagctctccacatattcatccctgatctcctttgctgttgctcgttcattgcccagcagaaacgatagaagaacctagggggtcaggaacatgtcagtctacctgtctcccaagaaaccagagcccacactaggccgctcaaaaactcaaaggccatcccatgcacttccttggggttgtgcctgtacttcagcagggccgtctgggggatctgatagttggtcatgggtttcctgaaggataaatcttctggaggataaactctcggatcttcgtcactgcctagatgtggggaaccaacacagggcatgaagctgcaacccttttgctgtatgagaggaactgggggaagcaacaatggtaaacataggcagaagggtggtgaatatctctttggtatttctcaagattttcaggaaacccagagagacaagaatggggctgcccagaaaaggcagggtgaagtccctggagacggctacagtgagctctgccaaggaaatccatagtgaagatcttgggaaggctgcttccatagcctccagggtatccatccctacttcccaccttgacccggagccgatcgagcacgccctgacatctgcgcaggctgctgtgcctctagcttcctgctctctgactgcggctgccttgcatccagctcctgtagctgctccaagaacctgggctctgtcactggagcctccagaatgccctggttagcagggaggggtgggatgagttacaagggagacccagacatccctaaacagacccagaccacactccttacctccagcccctgtcatctctaccaccttgcattgtacatatagtcaggacacatgtacaaagttttctattcctggacctccccactatacacctgtcttacatcattcttaatcttaatctttgatgcctaatgcatacctaaagaaatggtggtaacctggctactaatttctaaaaagcacttaacctggagccaggagacccatatggtaatagggtgggtcaccccagcccatccacctgctatggacattataacccttcaaactggaactcacgtgaccagagcagaaggcaccaccagaccatcaacaagctccccaagtttccccgaactgcctggcgatttcgaagtcgaatgttcatggctcctgactgttcctgcagtgccggatctcagagctgatggagctgaggtcactctgaaaagctcccaacatctgctccatcgctgtagggagggtagatgttgccggagtgctatagggtttgtaggggataagtgggcaccaaagactctttgtgaagtcttcagtatttatcagtccttgagggtggcagatgatagacaccccagattatcaggaaataacattaaatatggcagtaataacaaaaaaggctctgaagtcatcttgaaaatgaccctaacctgtccccatcttgaggctgatgacctaaaaaggcaccagagtccatgatctggttcagagtagctattaggggtcacaggtcatgattacaacctccaggacagcatcacaggctgtgatctggttgtgtagagatgctatattctcacctcttgaatatctgatccacaaaaagtcaaggggcctcatggtgaagatgggagatcctagatttgtagtacctctccaatttctctttgaagtgatagaaacctcagagatgttgacccagctgggacatctgtaccacacgccacaaaatccccatgtcaatagcaccaccccttcctctgctggaggatacaatcccgaatggatttctgttcaatctgctgtagctccagctaacttgctttgaatagtgacggagatctacaccctgggagaacataaagatgacaggtcgaaggaagtctcagtaaagggacactgtaacagaatcagtgaaggactaaagggtcagaaccaggctgatacaacaaaagcaagagactgttgtttttccttttggggtagaatagatgaagggcagattagtacaggggaaagcctcaccgttttaagagcttcctttactaactctcctccagatttgcctgaatgtgaactggaaatagaagtttatcataagggtccagctcacagctccctctccccacattgagtatctgcacaccaatccctaccttattccttccagccccatgcctctcagattacaggtactgcacccaccccatgccatcgcttaccatccactcatccaggatgaattcatcagaagtgatatccaactccccaagttgcagtggttcctgagcccaggaccacccgcctggaaagggataagttaatgggagtagggtacggtgaaagaagaaagaaaaaatataattggatatccccagtccttcaagtgagaaggagctgcttttatgggagccacaggtactgctttgaaaaattctaagagtctcacgttgtacccactctccattttgtgctgatgggtaaggaatacgacaaggagtgagacgatccagtgagacagtggggtagcccagcatggtggtgggctccttgtagtcccaactacttagaagctgagacgggagattgtttgaggagatcaggagttcaaggtcaacctgggtaacacagggaaacccgtcaaagaaaacaaaaaaaggtaaaagacaagacagtgcagtggaggccggacgcagtggctacgcctgtaatcccagcactttgggaggccgaggtgggaagatcacgaggtcaggagatgagaccatcctggctaacacagtgaaaccccgtctctactaaaaaatacaaaaaattagcgggcgcggtggcgggcgcctgtagtcccagctacttgggaggttgaggcaggagaatgcgtgaacccggaaggtggagcttgcagtgagccaagatcgcgccactgcactccagcctggcgacagagcaagactccgtctcaaaaaaaaaagtgcagtggagatgaccgaatgaggaagctaggaattgcagaggatagagcagaacttgcacttaaatttaagaccctcagactctgccatcttgggtgttctatcacacctctggggaaccccaggctttctagaaatgtcaaacacatagtgtttacctgcatgccaggtgcaatcttacacatattcatctaatcctaagacgatgtatacaataggttctatcttcctcaccttaaaggtgtgagaaatgatggcacgagaagctggttaacttgcccaagggcacacagcgtgtaagtggcagagatagaactcagcagtctggcttcagaggccatgttcttaacctttacactatactacttcgtgactctacccaaaatgtggagtgaagttgaaattttgtgccccagaacatgagtttcagccactaggtcccgctcagggtcgggtctgatcacagggaagggtacggggagccaaacaggtaatacacgggtagcagccaagttcccacccttgtgcctaaacccagctcaggtctttctgaagtaggagcaccggaactacggaggagaaacagctccgcgctctcaccagcgggccctcttctcctccatatctgaggtcccagcccgcaacaccagttcccgggccgcagccgccatggcgcagcggcggccattccccgcagcctcacttccggcaactgtcagtcccggcgagtccttccccggagtggagctacaagtcccaaagggtcttcctcagcgcgaaatcgttcccagtatttgagttaagttgtttgactccagctgtcccctttcagctctaaccacttcacccactgcaaatggaaatatggaagtctgaaacacaaactagccccggaaccttcgctgttctttacctatgaaccttacgaactgtaaagaaaggcgcaccggaagttgtggtacccaagcatactctcataaatccagccaggtcgcgctgaaacagtttccggaagcacttctcctagtcgcaccgcctcttcctcctggaagctatataatgatatcgcgtcacttccgctctctctccacaggaggcctacacgccgccgcttgtgctgcagccatggtaagactggaatccgtccgtgatccagcggcatcgcagctcgggcaaggaaagccggctgtcagggttctggaaagtcctgccctgagggcctgcgactttctgtatggagccttggatcgcgtccctggaaaggacaccaaagatttccaattccggagagcgggcccgaggaagggtcactgctcgggcgccgaaagctgtctaaggcttgggcgtatatggggaactctggcttttgccacgcacttttggaatgggcaggagacctgcttcctctctccagaggttgcattttcccaagcttgaacgttcatgtgcctactctgcaggactgaggagtttgctctgtggtgtgaaaacctaaggaaggggggcgggtgtcttgccacttgtgtgacaggcttaacctttttgtatgaagttcgttgccttatcggccttactgtttgatagtttactgtgtctgatttcttcccccgtacttttcaactagtctctagtgatccctgaaaagttccagcatattttgcgagtactcaacaccacatcgatgggcggcggaaaatagcctttgccatcactgccattaaggtaagtgaagtaggtaaggaatagggaatgtaaatgagaattgggttgtgaagacataagcaaaaatgaagcaggctggggagacttgagtctcatccagatcaccttgactgctggattaagaaaagaaatggtttagggagagactgacccctttagcatttaccacagaaaataagtgattaaagccagatagtggtctaaggtcaagccaaaacatttcacctggggaagtggggaggaggtatgttgctcacccgaattcgctaagattttcctgaaccacgagcttgtgagatttcttctagttcggtttctttacccatcccaccatcataacagcaacccttcctgcgaaatttatattcctgagaattggaggattattgggcatcttgagggataagtagaaataccaacagataaaagtgtgaagaagcctgtagatggagggtggaagaagtctgagtgggacatttactcagtgagccataattgacactcctttcctgtcgaagtgtgaaggagtacatccatctttcttggcttttaagaatcgaatcaatgaatgcaagaatattatttcacttgagtatttctctcacaaacctaatgaattcttggctttctagatacataacgttctttttttttcccttaagcagaatgtgtagttagttgtggaaatagcctaccagtatgtgtccatgcgtgcagggctggcctgtcttcttggcttctgttgcatggtaggtacttaggcgacgttagggaatggatgtagtagggatactgttggctctgttgaggaatttgtagagggaaattccttctgttggtgctctgtgaaactaataaggcagtgtgaaatactgtacttatttcagagaccggctgtaggcttaagtagaggtgcagcattcataagtgtaatagagaataaccttcatggatgtactaactaaaaattagaaatcttatttcatctatatctcttcccacacccattttgaagtaatcttttcacttgtaaacatataattaaatttgaggcttagtgcagtggctcactcggggctgaagtgggcggatcccctgaggtcaggagttcgagaccagcctggtcaacatggtaaacctcgtcatttaattaataaaaaatttgaaagaccctgctctcttctgaatcaaccaataatttgacccttggtcatgtttatttatttatcccgagacagagtctcaccccgtccccaggccggagtgcaatggtgcaatcttatctcactgcaacctcagcctcccaagtagtgagattacaggcacacgcccagctaatttttgtatttttagaagagatggggtttcacatgttggtcaaactggtcttaaacttctgacctcaggtgatccacccacctcagcctccaaagtgctgggattataggcgtgagccactgcacccagccacatttattttttgagacttcgcccaggctggagtggcggaatcactcttcactgcagcctcgacctccagggctcaatcaatcctcctacctcaactttccaagtagttggggctacaggtgtgcaccaccacatcggctaatctggatcttgctgtgttgtccaggctggtcttgaactcctgggctcagtgatctccagcctcagcctcctaaagtgctgggattacaggcatataggcatgagccacggtgagccaacccttgatctctttcttgcagataggaactgccatttgttttagtttcctggacctactgtaacaagttcatataaactaagcagaaaattactcttggcgctggaggcactaagaatcctaccttgcctcttcctgtcttctggtggttgtcagtaatccttagtgttcctggcttgtagctgcattactccaatctgttgctgtcatctcatggtcctcttcgtgtcttctcatgatttgtcattggatctagagcccaccctaatcaaatataacgtcattttaccaattatttccgtaacgaccttatttccaaatagggccacattctgatgttctagttggaaaaatgaggggcagggctcagtattcagttcctccttcactctccaaatcactttggttatgagttcagatggcatgggtgctagtgctggtgttgatgtgatgctaccaatgtaagcttagtttctttttataataacttgggcagtcagttctgggcactgacaaaattgagttttgatcttggaatactttgattatggggatacagtgatttgcctaaataattgtgaccctagagattctgaggaactgacagcccaataccttaatcaaagcctgtaactcataagacctggtttactgcatcagcttggagtggcaggccccttgttctcctaaatgcaagaatcagaggcacttagtgacaactacatatgctgagcaatgggggaaaaaaaagatactgcctgcttcaaagggttgtctgtaatactaaattctgtgttcatgattcagtcatacccctgaacaagttacttttttctttttttgagacggggtctcactgtcgcccaggttagagtgtggtgcgtgatcttggcttgctgcaacctccacctcctaggttcaagctattctgctgcagcccccaagtagctgggattacaggcacctgccaccatgctcagcaacttttcttgtattttagtagagacagggtttcaccatgttggccaggctggttttgaactcctgccctcaatgtatctgcccacttgggcctcccaaagtgctgggattacaggcgtgagccactgcgaccggccaaagttaaccttctgtcgaacggtttatatctggaaaggtgggtgaggaaagggtgactaggggattgcaaaatagattattgcagatcctacctttgtgagctttttgaatgaggtataaaggaatttaaaaatcagattcaacactaattccgaaacccctcacttcattcaggtgtgggccgaagatatgctcatgtggtgttgaggaaagcagacattgacctcaccaaggggcgggagaactcactgaggatgaggtgaggacaaggaagggggctgggggtggggtcgcctcagaaaggggtccatctagatctgaccttggtctgcctgccaggtggaacgtgtgtcaccattatgcagaatccacgccagtacaagatcccagactggttcttgaacagacagaggatgtaaaggatggaaaatacagccaggtgtgtactgaaatgagggcaggattagagaagggtggagggtcctaacagaattgggcataggaggtcaggggataaaacatcccttgcccctcctctgaatccaggtcctagccaatggtctggacaacaagctccgtgaagacctgagcgactgaagaagattcgggcccatagagggctgcgtcacttctgggggtgagtgggggtctcatctccctgcctacctcgactcagcattcctcctactcgctcttctttttcccaaccttttgtttctgctgtgcatgacctgtgactcttctctttttacctgcagccttcggtccgaggccagcacaccaagaccactggccgccgtggccgcaccgtgggtgtgtccaaaagaaataagtctgtaggccttgtctgttaataaatagtttatatacctatggcttccttcctttctgtccattctaatagggaatgttaaagtgctgggtcctttttccatttagagtgccctactcagttgcccacacagtgctattagttttagcagtggtgatgctgcagacccccagtctccctatatgtagctagtgatgtccctctctgtaaagagaaatgtgagggtaaacagttcagccttgaggggctgacccagaccagtttagagaccaacaccctggggttgtgtgcagcatcattgtggagtgggttagctgagcctagccagttgcagttaaggtgagttgcaggtcttggtcactctgggtttttttgtttttgtttttgttttcttttaaggggtctctagtcataagggaaaatccttcgggctgtgaccgaagcaacaaaggcaaaaacgcggcgttggttatgaagggtgtggtctccctggtggagtacgtcggtgggttgggatggggacggctggacagaccggtctcactccgtttggtgccactccacccgcccgggtttccgcgcctgccgcgctgctccgacgccgcttccggcggggatgggagcgcgcaacgcggaagcggcggcagaccggccgccggggcgaggcgggggaggggccgtgagtgccgcagtcggccaccatggagcggagcttgctggcggcgaggccgcggcgacaaggtagccacccccgcagctgcctcgaccgcggtccgcagctgcaccgcctctccccgccccccagggtgcgctggtccggtcgcgcgctcagacctccgcatcccgggcgtggtcggttaagtccccggccgtgaccaggcccggggagctagtctccgcccttcgctcttacggatcccctcggagtacgccgcccatgcagctcaggctcttccggcgcctccttctcgccgctttgctgctggtgatcgtcggaccctcttcgggccttcggggttgggggaggagctgctgagcctctcactagcctcctgctcccagcccccgcctcaccggggccgcccctggccctgccccgcctcttgatccccaccaggaagcttgcagtggtcccggggcccctcccttcctgctcatcctggtgtgcacgctccggagaacctgaaccagagaaacgccattcgggcttcgtggggcgggctgcgcgagcccgggggctcagggtacagacgctattcttgctgggagagccgaacgcacagcacccctgtggggttcccaggggagtgacctggcctcggagtcagcagcccagggggatatcttgaggccgccttccaggactcctaccgcaacctcaccctaaagaccctcagcgggctgaacgggctgagaaacactgccccatggcccgatacgtcctcaagacggacgatgatgtgtattcaacgtccctgaactggtatcagagctggtcttgcgagggggccgttgggggcaatggagagaagcacggaaccccagagagaggctgagcaggaaggaggccaggttttgcacagcaggaagtgcctcttctgtacttgggccgggtgcactggcgcgtgaacccctctcggacacggggggcaggcaccgcgtatcagaggagcagtggcctcacacctggggcccctttccacctatgcctcaggcacggggtatgtgctgtcagcgtctgctgtgcagctcattctcaagtggccagccgggcaccccttctcccattagaggatgtctttgtgggggtaagtgcccgagaggaggcctcgccccaacacagtgtgtcaagctggctggtgccacccactacccgctaaccggtgctgctatgggaaattcctgctgacgtcccacaggctggacccctggaagatgaggaagcctggaagctggtgggtggctctgacggggaaaggactgcgcccttttgctccggttccagggagtcctgggcatcctgcggtgtcgagcaatagcctggcttcagagctgaagtgcctggggccacaggaaaggcaggaacaggaccttctctctcccaggcccaacgcagggccctcactggctgcagctgatctgtttccttataccagatcctcagtctcactaaaacagcgatatgggagacacccaggggcctggcccgccagcccaaaagatggtcatcgggagagaaaaagaaaaaaatgctgcagttgttctctcaagctagggcagaagaggggtgtcagctcctcaataaacttgtctccacttcttcgagtgcagtgtggtcttcaccaggaccccagaacaccacaaacctggagagcccagaggctgccagaccctgctgcatgggaaggactctccagggacatgggagagaggacagcctctctgaggaggaaggcccctaaaaggcaagctaaggccacagcagccacaaggtatggggtgggggtagaggcaggacactgacccctcgatcctagaatggcctcatgcttggcaagggggaggggaacaggtccacaagatgatcagacacattatccaaaaaatcgctttcctctttaataccaacccaccccaggagacagcgtccacccccagttggggaaggggccacactgcccccacctccttgttccagggaacaccatttccctacaggtgatcttggggagagactgttcccaggcaaccctggagtctggctagcgcacaaatctgtccagggcagatggccgggcccccgtgggcttggccttcgcctcctatgatgctgctgctgaaggctctgccggaccttgtcctggggaccggagacggggaggcacaggcacagagtgagaagtggcaggctgacaagggcagaggcacaagcaggagggtgagcctgtggaaggcccggcccatgccaatgctcatttaccctgtgttcctcatccatgacttcctcttcctcttcaccaggcttgccgtggagctgcggcccttctgctttggctttgctggaagggagccttagcctgcgggtcatagccctgagggaggggacaggagtgatatcgttacagcctcggagtcagggaactggcagcacccacctgctggccgcacttctggggaaagccatggtggggagaggatgtgggggagaagacgggcctgggcattcaggggcctgcccataccagcctctctatctgctccttctttccctgctccagggagatgacatccacctggccagggctcgtgggtccagacaaataagctctgcaggtacctgggggtgtcacagaggacaggactcagcaaggagccacaggagggtagcaccaaaaagagaagccagggaggctctgaacccctctacccaagacccccagcatgagacatcaggagagctttctctacctccaccccaaaccacaccttccccagcagcaggggcctcactctctgcagcaggggaacctccctccaacaggggcaatctcaccctctccagcaggggggaacctgaccctctccaggaggggaatttcaccctctccagcagagggaaacctgaccctctccagcagggggaatctcacctctccagcagagggaaacctgaccccgtccaggagaggggaatctcaccctctccagaagaggaaaccttaccttctccagcaggggggaacctgaccttctccagcagtggggaactgaccttctccagcaggggggaacctgaccttctccaggaaggaggaacctcaccctcccaggacgggggaacctgaccctctccagcaatgggggggatctcaccctctccagcagggagcctcaccttctctagcagggccttcacctcccactcctggcgctgcttccggctttgtatggattactctccaggccatcgaagttgggctcaccggcccctgaagggagggaggagaagcatggagccataaggaagaacctcagtccaacagctccagcccaactaagccccagttcctggatgtctctggcccaaacttccacccagagttcattcacttcaagccccacccctggcccactcaccagggaccagcatgctggtgatgcccccagtgtgccccaccccagcacatcttcaaaggggcagaactgaaggccatgcacagggcctgagagccggtgggtaggtagggctgttcaagggagggtgggctggccttgccctgccctgcccagatgttgacacgtcacccattcccgccaccagcagtcccctctgggagaaggccaggtgccctgctcctggggcagggtccgagtgctcagaggctggtacgtccctcgcaagtcaaagatcttcagtggtggtctaggccagaggtggccatgtacctggtgagagaagagggatcaattaatattcagtaaatgggtttaccaagcaagctgtggccaagtccaggcatcaagtctggctgggagaaaaagattaatagtaataaccactgccatcaccctgaacactccacaggcatcctccagttaagctgcacacaactcatactatttttatttccctttaagaggtgaggaaactgagctcagggaaaggaaagctaggtcagtgaatggtcaggcctgtctctttagcatctgctctaacctgctaacaccacacagccctctcaagacacgggcgtcaaaaggaacgcccaccgacaggctgcacccaaatgtgatgtccccctgtacacacatgcagcacacagcccagcaggggaaggagcatgtgcagtggtcagaaaggcttcatgggaaaggtgggatttgagccttctagataattctcaaaaaattacaggaagtagatacacagcaggttcaaatgcattacaccagagtgttgagactgagagggaagcagaggtttgttaggattggtgggaaacatgtcaggaaaatcaggagcagacaatttgtgaggtttctttaaagtcagactgaggacccaagctcatgatcccaacattgctctctggcagtgacaaatcacaaagtgaaggctccaagacttgagaagacctactcagggaagtggtgaagtaatgcactggaggcccttgccctgccctctgtgtgctttccctggaaggaaggagggaaggttggtgaccaaatcctctccaggatcatgtactgcataagttgtttactttcagaagttggagttccttttctttttttgagcagggtctctctgttgcccaagctggagtgcagtggcatgaccctggctcactgcagccctgcctccctggttcaagtgattctcgtgcctcagcctcccaagtagctgggattacagcatgcgccaccaccgctaatttttagtagagccagggtttcgccatgttgaccacgctgtcttgaactcctggcctcaaatgacctgcccaccttggcctcccagagtgctgggattaaggtgaggttggagtttctatgttcaagttgttccttagagagggaagctgaagggggacagccaggtaggggatgtatgtttgccaagaggccaaggagtctcttttttgccttggcgtgaacccaggagaagggaactgaagagttcttatgagcagagacttgcacagtgatgggcccaagagaggaccagctggatacttccgacaagataatcagcgccctgactttaccaagagaaaggccatcagtgcaaaccaggaattaccgagcgctcgtggaacacagggtcactcctttggtgaactaacaactcaaggatgcatgctggctcttctcccctccacacaccctctatgggacccctgggtaaagaccagcccagtgccaaatgggagtctactgtactactgtaagcagcagttcggctttgagaagtcaacgcaatccaatcataatacaagctaccagacacctcttaagaaagatggtcagcctcatcactggagcccccgtggcctgacaagctctgaggaggaccagagaaaagcagggatgggctgaagatcacaaggaccagagctgtttacctcaaggtgttgattaaacttcaggcctcagcgaactagtgattaagccctaagcacagagtggctgacccaggtagcccacggagggcaagctacagctttggcccagtggcccaggagggcagaaacccttgggcaggccttctgactctcctagagccaggctggtataaataggagtaaaaagggcagaaccaaatcactcattcacaaagatacaattacaaaggccagaacggtggctcacgcctataatcccagcactttgggaggacaggcgggtggatcacaaggcaggagttcaagaccagcctggccaacatggtgaaattccatctgtactacaaatacaaaattagccgggtgtggtggcacacacctgtagtcccagcttctcaggaggctgaggcagagaatcgcttgaacccaggaggtggaggttgcagtgagccgagaccacaccattgcactcagcctgggtgacagagtgagactccgtctcaaaaaaaaaagatacaattatgcaaaaaagggagcgggtggtggggggggtggtcccagcatcctggagactttgaataagctggtgccaagctggatgtggtggctcacagtaattactctgtaatcccagtactttgggaggttaggtaggaggaccgcttgagcccaggagttcaagacagagaccagcctgggctacatgggaaaccccatctctacaaaaaatagaaaaattatccaggtgtggtggtgtgtacctgagcaaattctgggtgacaggaaaattctgggagatgagagcaggtcaagagaaactttaggggcggtgacctatccagtgatggacacattgagtctgggatgacagaggataactgtgtgaaactaatggcatcacctgagctaggcgtggtggctcatgcctgtaatcccagcacttgggaggccgaggtgggcggatcacctgaggtcaggagtttgagaccagccaagccaacaggcaaaaccccatctctactaaaaatacaaaaattagcgcatgcagtggcatgcacttgactcccagctacttggaggctgaggcagaacaatcacttgagcctaggaggcggaggtttaatgaaccgagatcgcgccactgcactccagcctgggtgatagatcaagactccgtctgaaaaatagtaataaaataaataaatgcatcacctggccaatcattctcaaaaaccataccatggccgggtgcagtggctcacgcctgtaatcccaacacttgcactttgggaggccgagcaggtggatcacgatgtcaggagttcaagaccagcctggccaagatggtgaaacccctctctactaaacattaaaaaattaactgggcgtggttcgtgggcgcctgtaatcccagcactcaggaggctgaggcaggagaatcgcttgaaccccggggggcagaggttgtggtgagtgagattgtgccactgcactccagcctgggtgacagatcaagactctgtctcaaaaaaaaaaaaaaatagccacaagtttttatacctaaaggataacgggagcaccacaccagggcagctcaacgattcatccttttgtctccagaacctcagcgcagagccctgcccacagcagggcccagtgaatacctgatgacaaaaggaatcagaggaaaatacaaatcagacagaaaagtgtggaaaatgcagatactccctcaggaacagcagaaatccaaagcagacaccacctcccccctcacatcagccagacctggagagaacgatcatcttgaatgacaatgatgaacacacgctccctattttgctaagcgctgtgctaaactatatgccttaactcatcttaatgtctcaacagcttatatgagggctttaaaccaaggcttggtaaactactgcccatgggccaaactggcccatcatctagttctgtatagcccacaagccaagaatggtttttacatttttaatggttgaaaaaaaatcaaaagaatattttgagactgtgaaaaccgtatgaaattcaaatccaatatccaacaaataaagttttattggaacggggccacactatttacttaatactgtgctgcttttgctctacaacacacagccgagtggtcacgacagcgactacagcatcctgattgcactgctgctttgtacactacaagtcacagtgacacagtcgtaagtgcttcacagctttcaagcacctcacatatcacctatcattacctgtgtgaaaagatgttttcaaagatgaatacttgcaatctctacagatcagcatgaacatgaatatctacagtcaaatttgaccactggaacactaactttgtacatcaattaggcaaaatgttaacctcaaaaagagaaattcgttcttcccattagtagatctgtattacacaaatatatttgattattattatttttttttctgagaccgggtctcactctgttgcccatgctagagtgcagtggcatgatcacagctcctgcagccttaacctcctgggctgaggtgggaggatcacctcagcctcctgagtagctggactacaggcatgcaccaccacacccggctaatttttctatcttctgtagagacagagtttgccatgtcatgggtgacatggcttgtttcgaacttctgggctcaagtgatctgcccactcagcctaccaaactgttaagattacaggcatgagccactgtgtccagtctcatattagttttgtttgtttgtttgtttttgagacggagttttgctcttgttgcccaggttggagtcaatggcacagtcttggctcactgcaacccctgcctcccaggttcaagcaattctcctgctcagcctcccaagttgccggaattacaggcccccgccacgacacccggctaattttgtaatttttagtagagacagagtttcgccatgttggccaggctggtctcaaactcctgacccaggcgatccacccgccttggcctccaaagtgctgggattacaggcgtgagccaccgcactggccatattacgtttaattttataacctaaaaatgtgtgggccaggcgcagtggctccgcctgtaatcccaacactttgggaggccgaggcgggcagatcatctgaggtcaggagtcaagaccagcctggccaacacagtaaaaccccgtctctacaaaaaaatacaaaattagcgggcatgatggcaggtgcctgtaatcccagctacttgggagactgaggcaggagaatcgttgaatctgggaggcggaggttgcagtgagccgagatcacgccactgcactccaacctggagacagagcaagactacgtctctctcaaaagatttaaaaaaaaaaaggtcaggcgcagggctcacgcctataatcccagcactttgggaggctgaggcgggcagatcacttgaggtcggaattcgagaccagcctgaacaacatgctgaaaccctgtctctactaaaaatacaaaattagccaggtgttgtagcaggcgcctgtagtcccagatactcgagaggccaaggcaggaaatcacttgaacctgagaggtggaggttgcagtgagctgagattgcgccattgcactccgcctgggtgtcagagcgagactccatctcaaaaaaaaaagttgtgataatttgttttctttggtatttaaatgcctacatggtaccctttgattttacctcttatcagcaaatcataaatatttactatctgactctttacagaaaaagtttgtggacccttgaaatggacactcattttccattttcggggtcaggaaactgtggcacacagaggttatgaaatatgcctatactgcaaggcccatccgtggtaacactgcgatttaaacctgggcatcctggctttagactcttgctcctaaagcacactgccttccacacctttctgcccacctatgactcctaacacctcccccaccagtgacttacgtgcctgtagaatctactgccacagcccggaccccaccacgagacagagaatctttgccagtggctccttcatagctggactccataaagacacagtacctgaagagaagaagaaccaaagttgctaatacacacctaagcctgaggttactaaacatggaaagatgggaactcaagaccaagagataacaaaaaagggaaataaaagggtaactttaaggactcatgaagtacaaatatagaagaaaagcaagtcaggatggtcagagtcaaaactagccaggtactgaccattgctgtgtccgagatggatgacggcattgtaagggttctgactataacatcgagccgcccagctcgagcattcagagctgccacaatcttccccactgacactccaggtaggttagaaaccctgtttctgactgagagagaaagacagagagaatgacccatcctgattgccctctgtattccctctgctggggtcctaaaggagaggtggtcatcccaaggcttccaaccagttcctgagctccatggccactcacagctgtagccaggaggaagtggagggcaggaactcaagccgtgttactcggtcacagcggcggatacagtggagctcaatgcctgattgtcatagatgtggagccagcggttctgagcaacagcaagcagtgcctcagaaggagaaacctgggggagaggaagagtggttcaattgggaaatgaggtcacaggctatcatcaatcaggaatggactatctcaccccaactgaccgctgacagtgaggccactgaccggtgtcccgcaccgcctccatgacgttgatctcgcacataagcttctttgttacccaatcagggcagccacatgacctcggcgccctccaaaagccaggtgtctgttggaggtgaggggcggcagggtgttaaggcaggggaccaccgactcagacaacttgaggtctgccccacgccaccccatctctccaggcgggcagacacatgttgctgtaggtgcttaccctcacacccaagaaatcgaaggaccctcccctcatcagcaacccaaacatacactgggaatggctgaagtgttaaggaaacacatcttagttcaagagtcactagaattcaaccttaccttccagttcgaagtagtttagtctgtagggtccaaactgccgcagattcaagtcaaagtgctgggaaagaaagagtgaaaaaaaagagtgccctgcagtaacgccttcttctagcccccattcctctatgtcctgcaccaccaatcaatcccttggctcctttacctcctcaggctcaccttggctgccttgcaatgtccacagcctccacaatgtcagcctggcatatctttgctgtgtcttcccctcctccccttccagaaacctgaaagcaagggttaggatggcagtaaagcttcccaatataagcaagtataccaacataaaaacgagaaaagacagtcccaaaaggcagggaatgggggccagattagggctcactcacccaggttcttcagcaagcagcagctcagaacgagcagcttgatacttgtttcctcttcctcagcttcagccacctcaagtcggcttcgagttttggcttagaatgtggtagctgtaacattgttggtggggaggagtggcagaagaaccacaggatagtggggtcacaggagagctacctgtcccagcctccatccaactcacccagacactccctcctccagcacttcccaactctccggctggacctcacctttcgggatttgtcaatgcgacgaacttctggaccacttccacagggacgggggcggggcctgggaatggatcttgggcctggggaaaggaggacgcaattagcagacagccttggattgaccccaaccctctcactctcaggaacgaggcggcctgcctcgccacccatcaggtcccacgctcaccccggacaagccggctgggactccgggttcttccattctcggggtttcttcgggacctgaggcttcttagagtccgagacttctttaagatgtaagcattttttggtctctgaggacggagctcccgattctcttgttacgaggaggccctggagaggctccggctgtggtcggaacggtctcttcctccagtatcgccgcggtttctacaggcacatcaggaactccgcactcacgccccgccccccgccccacagctaaaaacttcgtttcccacccagggaggcctctacctttctcttggtctgagtttgtctttcttgggcgggacatccttgcccggcttgggggctgtctccatctcgccacccgaacggcgatccacgtgcaaaactcctctcagctgccacacagtcggcttgaaaatcccggaagccctctgtccttcatccaatcagcagcgtaccaggtatgaagctctctagtgccatcttgagtgagggcacgctctccttagaggggcggaacagtttttggcaccttacgcgagcggcagcttatgcaagagtgacttaaaaaagaaaggcaggtccggagccagggctaagtagcggtgcggtttctttttctggattagtttccccatcttgcctaaaaatgtctagtctagtctttttagcagaactccactccctaaacatgtcagaactacacttcccataagggtcagaaagaaacttccggcacagtcttttcccagcattccttgtttacttccggtttattactactgaaggaagaacgtgagtaggttaggatttcggttgagaggcttggggcttgcgtttcgcccaccatctcctggggacagggtggagtcgatatccgggacggggggaggttgcggtgcccctcagggctacctctcaagagtgctatcatttccgcaggccagatagaaaagggagctcaggtaccttccagagagtgagacccagcgcccttgtctcgcacccgtaggctttcatccccgccatggcggagctgatccagaagaagctacagggagaagtgggaaatatcaacagctacagaagggtaagggaacagggtcggtatggtctcgcccaatgccttacaacccaaagccattaccgagataaggtttgttgccccatctgggccctcgcgtgagagacttccccgcctcagtctcagtactcttccctgttcactcacccgctgcccccatcttttctgcttcctcagatccatatccacctgactaggattgtggggataggtggcacattgatgtttctaaattgcctttcctctcatccccagacttaagtaaatccatgtcggggggcagaaacttgaagcacaactaacagaaaataatatcgtgaaagaggtgagggactggatttgtggggcgaggagggacctgtactagccatggttctgatcacatatgtcccatcctccatcaggaactggccctgctggatgggtccaacgtggtctttaaacttctgggtccgtgctagtcaaacaggagctgggggaggctcgggccacagtagggaagaggctggactattcacagctgaaatgtgagtttttattccaccaccgtgtgctgcaccctgtgatgcaagtaaccattggagtagaggtgttgaaccattgcagaacagctctccatagtggcccctagtctccagttcctccaaccctttccttcccttttaaccccccttcttctccctcccctggactcaagttttccacctatctctttcttgcgtttagcactctccatagtgagtcctactatttctccctttctgcttgtctcccttgtctctccttagtaagcgatacgaatcccagctcgggatcttgagcggcagtcagagcaacagagggagacccttgctcagctgcagcaggattccagcgggcccaggcagcaaaggcaggggctcctggcaaggcctgaccccatggtgggggaggggaggggaggggagggaatgaggcagctctaggatctatactgtagctaataaatgtaaaaacacctggctctgtttcctgaccaggcacttctgtcatatccccacagcccttccaccttaacacacaccacctgtattaccccctcaggttcaaactcttgcacttggatctctttgtggcacagtgttctttcttgaaagtgaaatcctaaatgtcttcaaacctactcttgcctgtatatacaacccttaactctccctcatcttggttggcatgattcttttggagggcatttgcaacataccatattgctaggaatgtcggtttaattgaaaaagaatacacgttctctaacctgaggccccaggatgaaatgtggttaccctccttgccaacagccctggatctctattagtacttttcagcctctgtcttcctagaatttgcttgaatgtagctttaactgacttaaaatcccagcatgtaatgctttatggtattataagtcctcccaagtttatagttgtccataaagttgttctgccatttccttgtcctaaaattgttttatacacatttgcgcaagggaccagtggtagagaggttactggagagaaactgttctgaggaaacttttttcccaatacctcactttttgctctgttcatggggacagaaaacattgtgccccttcctgttcatggcatctaccttcagccaattccccacccccactcatagcagccagttcatatgtatgcaaggacaggggagtagaattcaggtagtgttttggtttattatcttagtgttgtcaagtgatagaaacccccagagtgggaagaagagctcctgcgaggacctacattttgccatcccctctgccctggggctcagagccttgaagcctttgcttggcccttgcatgttaggattggccaagaatcagaaactgatgcgtttttccagcactacctgtgtgctgcactcatggaggtgggaagctatacacaggtatccaacttggttataagacaccagttcccacagggcggatttctcagctgtctggtaaaccagtggcacttcactgccccagggtggctggctcctttctgaatttctgtctcaatgtgatataattgccaccattcaggatggctacccacattggtatgaacaccatgacttctgtaagccaacggggcttcctcctcagaacagtgcccggcaatcttcctccctgtggccttgatcctgggaaaggagccccctcctccctcactcggggagttcctgaggcagacgggccactggtgacgccaggtgtagcagtagaggaccttcgcgctgccgcaggaggaaatcgtgtgaagctccatccatggcgtagaatacattagccgagctgggatagtcagctctgaaggttcaggggatggatgtaaagcacacacacagttgttcccccacagccgcccagatgtggaagtactccactctcctcccgagtctgcctttccctatggcctctgacctcgctcccctggtagcagctgtaccagctcatactctgaagccactcagagtcacgattgtttttcttaaggacacgactgatgacacttggagccttgtcctggttgtcacctggcagaacaggagaccaaaagagcaatcaatcagccatgatttcccatcctctaccctcagccactgaacccaaccacaaaatgttacttgtgtccaaggctttaaaataacaggaaaacccaatatggtggcttcctataccccataagccagcccacatggtgcccgtgaaacagagctgcttccctgtggggaaactgctgttgattctgaaattttaacacgggaccaaaagtttaaggtgtagcaactaatgcaaaatagccatcaaaataaaacaaatttagcttctattgaagactagagtttagaagataaaattaaaaataaaacataactgccaaaccaaaggtcaaaattaaaactacattcaattccatttggctgcccaaacctcagacaaatttatagtccaacaagacaccatccttcaccccaactccatcccaaggctccctcaccaaatgctcttatagacactgccatcttcccccaactccatctggactcggatgatacggaatcagaggcccctggcccagatccctctcccccatatccagtccccccggaggcctctctgcacccccactcagcggggagccacaggaggctgagcggcggtgacctcgagaaggctaggggaggaggctggtggggagaggtggctggggtcagctggactgtgcagggatggatgctttccaaggcagagtctagtgacgagacagatggccacttcatgtgctaggaacaacaacatgggactggcatgaaggcagggaggtttaaggaagaaacatttacagagtgaggtcagcgtcaaggtcagagtcaggagcagagctcacctgggccagccgagtcagcagagggcaggagttgtaggcgcctcatctcccccagtactgggccggtcacaggacacaagcgggtagggaccccaacagagcccaaaaccctgcagtggcaggagattgggaggatcagagaaagtggaagtcccaagaaaccaccccccagccagtgaatctctcactctgtccactgcggatgaccaatgttggccgaagcacccgtggggcaggagggtcactggaaccaggtggctcacctcacaggatacacgatggctgggttaggggggcaataggcagagctcaggacatgcaccaatcccccacacctggccagaaccctggagtcccaacctcacccgccagtcaccttgagcctctgtcagtggccggagcccctgtagccacctctggatatcatggtcaggttgaggttatagccacgacattcattctggagccgtcgcaactcagaaaggactgcaaactctgggaaggagccctcaaactgcaggagccaaaactcagggacccctgacttttccccctcccttcctggaacatggatagggaagtccagcatccagcccagacactccgctcaccttctccgcttgtcaaaattgatgtatccattctgcgaggaaaatggggatggggtgaaagtccaaccctaccttccggccacagagagagaatatcccctctcttaaacacacacagccaatccaactcacaaccacttccctccagcctctctgactcttcgatccctccctgccttctcctcaatctatcatggcctaagcactccacttgaccctttaaattgaatttctcaggtgacaacgagtctgctttgcagatgagaggactggatagtatccaattcgacaggattcctatccagagaggataaggaacttgtccaaggtctcagtatttgtttatttaacaaactcagcaatagagcaggagcccatcacaaaacctagatgtgcttacgtttcaggcacgttctagcacttgacaaatacaaattcatttaacccttataacagatcaatgtagatgctattttagtttcccatttacagatcactgaggcgacttggcacagaaacagatctggctctgtccacactcagctatttgtgccttacagccccttgcaaggggcgggggggtctgtccgacctgcagcccacttgttacatcattgcaatgacacacacacacaccactgacctccaactctccttggaggctgcatccagcatcacaaggtccttcaggaaggtgccaaggtatgggacacaccctgaagtcaggggtcagggtcagaagtgcctgccattgacgtgagggccctccaccctccgcacttgccctcctcattgcctcagagaacagatttcattctcctcacccctcgtgcctcccttacccatccttcaggctgctcccccaaaacatactcctcaccccttcatatcaccacccccacgcccaccaccccgctagtcactcaccccaccccgggagccagacccggggccttcttggagtgtggctccagaggagactgcagcttcacctcctggtggtgacaaataaaagagacatgggggagcagtagggaacaaggagaggtgggaatgccacaaaccggctctcacctgcacgagcagctcccgactctgggaataattatcctcctcggagaaaactggcagaggctggaaaagactctgaggctgtccctggggaagggagaaaagtggccctaggacaggcctggctctgtcaccccctcttccccgccttctgaggaacccccaccccagccaatgcctcagcctccgcacctggttgcttccccccaggctgcccgaagcctgtggatgggctggactgcagggctgacaccacggcataaactgaagagaagtttcggagcagccgcactcctgtgggggtcaaagaagagagctaaggctatgggaggcctctccattccatggcacaaaccgtagggcaatcttctctctcacctctgccacgcggatccacttctccaggaccgggccctctgtgggggacggagtggccgtatggtcacctccccaggtccctctccagggaagtagcccccaggacagaactaaccactgcccctgccaccttgttaaactgtgtgaagtagctcggacagatgggcagaggtgagaatgtcctggccggtctctgtgaccccacagcctcccaggcactgagaggggatcaaattgagaaaaagttcctgcagggtagaggtcaaggttaaagttcatagtcaagtgaggtcagccttccaatatcagggatctgaggatctcggtggccaaggaaccagaggggcacagggtttgaagggtaacgaccaaagggaaaagggagaatcaaaatggtaggtggaggaggctaggagctggatcaggaaggggtggaagcaagaaaggatctggagtcaaggagaggttagtaaggggtcagggggcataggggccagaggtagggtctcaccgcatctagcagggtcagctgttcggccaagtggtcagcgaggaacaccggacatccgtggggtcagcagggggatcgccggggagggccaggggcttaggaaggtcggggcctgggggtccacccgggaccggagattgcggatgaggtcagcgctgccccccccacacccttccctgctgcataccctgtctgaagtaagaagctctcaagccggtcaagctgaccttggcctcagagccaaaatcctcagggtgagaggccagccaggttgacagtacagagtggctaccctgggagaagggaatcagccaagggtgagaggtaaagctgcagcctgggcaaggggactgtgagattaagaaccaggggtcactcactctgttgtcctctctagttcgtcgtaggatgagattcaagggcttccagcctgagggggagaagaggatctatctgtccattttcccaaaccctcagtggctttgactattttggtgggatgttgcggctttaggaaatccggcagatactccactaccctgcgtcccttatgactctgacctgtcagccataagccctacaaggcaggcgtggaggtgaaggcccggtgggtagccaggaaggctgacatgaagctcaatcagtccctgatgtccgggtatccagtaggtgtctgaccagggcctccagagtgccagtcggagccgtcgggaggaacgtgggggaggcatagggacctggagaacacagagagatgtcgctaaccctttctcccactctgcacctagatttctgaggacaatcccagacccaggaatgttccagactcatttttctgatattcagagagggcaagagtcttggcctatgtcacaagcagagtccaggactccagaactccaacctagcactctggccagaaagtcagccagagaaggaaaactgggaatgaagagtcagaggtgagaagctaaagtcatgatctcaccaaggatcaagaggtcgatattggcggcttgtgacggtaaacacggcaccatcctcctcctcatccagacggacacaggggcctggaggagcaaggaaggggaagtcagacagttccacaccacccccattgccctcagccttcaccccaggccctgctcctccctctgtacccctcacctgggtggcagggcatagtaccagcgagtgcgaggaagggttgggggagctggtgaccccagtctcccccactggggcccagacagccccaccccagccgcctcagggccccggtggagtcaaggggctgcagtggaggcgtggatggagtacaggaattctgatcctggagacccccaagccccttctccccagagctgaacccacacacgacagagaagcagggtacaaagggcagggagggaagcgagaggcagcaagccagaggcagcgactaggggtagctgaaacctcagtcaggcactgccgcatgccccgcccctcccggccaaggactataccagcccagagaattagctttttcaggacccctttcaccctggtccctcgggtagcgcctccactatctcagccctagggacccccgaaggtagcagctccaatcccagtacaggaaggaaaaggggaagtgggagatagggggttgggggcggtagactcagagagtcacgtggccccagcccctcccccgacgatcccgaaaaaccagccctgccagtcaacctgccctcacctaggatctggacctaggatttagggcctcggggccccaaatccaaattctggcccctcctgaggcccgaaatcctgccctggccaccaccattaatccctaatgaaaacagatgaccactctctacccaccctaggtctttcctccaggtcccagaaccgtggcttcccggcctctacccaggaccggggcgggggggggggcggggggaagggggagagagggaaggaggggtcacgaaatctgagggttcccccccaatcccagagtcagaggagctggttactgtggaaacaaacccctccccgccaaacaaaacaaggagggagacagggaccaagacacgactgctcagagaggtaggcacactcagcaggcagaggtggagggccaaagacccgcagggacaggacagccagccagaagttccagcaggaacagggcaggttcctgcgggcaggtcctgagtcacactgacagagaaccacggaacgccaggactccccgcagcagagaaacgggccgacacccagggaggcgcgagaataacgaggcaaggaggaggagatgtagggacccagagacaagagaaaagtggagacttcagaatacatacgccccctacctcccaccacccgcgtctcacctcttcttcttcctcctcctctcctcctgccccccgcccacgaccaggccacctgggcccccaccctcttcggggtcccggttcggaagctgctcagtacgactcccccgggggggctcgtgtccaaaagcagccgcagggccgcgggagcatggccgagtgaaggaatcagcggggtcgggccatgggggcgcctgggagagacggggtggggtgggggtggagagtcaggcaggcgcgggggaaccgggcagggaaggacgtgggtgggtgtcaagaagaccggaagggagttctgcaggaaggttgggggaggggcaacagaagggtggaataggggggcccttggtgctgttggggaaggaggaggtcacgatacggggacgcgcagggtgctcaggctctgacctgctcgggaggggtgggggcagcgtggtcctgagccgctgttgccgtcggtctccggccccggaccgagtcccctccccggctttccgtacccccttgaacccccccgccgggctcctgggccctcccgccctttccgctccccccgcgtccgcccgctccgagagcaggagccaaaaggggaaggaagtgaggacaggagccgggccgcggactaggggagcgctggacgctcagggaccaggacccaggcgcccgagtcccagctccactgtcctccgcctctacactcggggattctggagaccacgtcgacccgcaagaactggaataaagattccagtctccagcccctgggggaaggcaggagcagaatttgacttcccttccccaacaataacacggctaaaactcccgcgggaagcgtttcaggcggagaggagccggtcactccatccccacgggattaccctccctaccacaacccacgaatgtagctaccgaaatcccggccgggttttccgaagggccctcgattcccgccccctcggcagggggggggcaggaagcagccacatccggttccagattcggctctcagaggcttccggcgccgaaccgagatccccgtcggctcggtgtatcctcgctggtggagtaccctctgcttgagcgctctcatgcgccagtagtggcgcccgccccgaacggtgtcgacggggcgttctctgagcgttcagggtcactggaagggaccagaggtgattggaatattcattgagcttggaaaggggtggaatgagagaaccgtttggaagcactggaatacagctttattcctacacgattagaccgttaccccgtgggtctggccgaccgtcctgactcggagatccctgagctgcgccgccgttccttcgtcaacatccagcagctacttgatgagcgccctccagtgggccttaggtcccatgccggcgcggggttacagcagtggacagacaggccagtccctgtcctcgaggagccctgatccgcggggagacaggcatttaacgacgactcacacgatcacttaaatacaactgtgtgaaccgcacaagagggacgcgcggcggtctgcggggaatgacgaggccgacctcgtcgcgacccagggagggcaagggtggaccaggcaaagggaacagaggactgggacctggagtgggcgggaggcgtttggttcattggaggaaaggaatagccctgtgtgtgatgagcattagaggaggtctggcgagcaccatctagggctgaagaactaggcagtggctccagcgcgggcggtgggggggacaagtgagccagggcaagaagaatggatttggccctagagtacgggtctccaaatgtaacctcggccctacagatctctgagactatgtcagggggtttgtgagatttataacaaaattaagatgttagtacaatatcgtgtttcgccgccgggcgcggtggctacgcctgtaatcccagcactttgggaggccgaggcgggcagatcacaaggtcaggagatgagaccatcctggctaacacggtgaaaccccgtctctactaaaaacacaaaaagttagcgggcgtggtggcgggcccctgtagtcccagctactcgggaagctgaggcaggagaatgggtgaacccgggaggcggagcgtgccgtgagccgagatcgtgccactgcactccagcctggcaacagagcgagactctgtctcagaaaaaaagaaaaaaagaaagattatttgcagccggcgcggtggctcacgcgggtaatcccaatactttgggaggccgaggcgggcggatcaccggttaggagatcgagaccatcctggctaacacggtgaaaccccgtctctactaaaaaatcaaaatattagccaggcatggtggaggacgcctgtagtccgagctacttgggaggctgagcaggagaatggcgtgaacccgagaggcggagcttgcagtgagccgagatcgcgccactcactccagcctgggcgacagagcgagactcagtctcaaaaaaaaaaaaaaaaagtttttgccttcttcattctataagtgtacagtggagtttttcagaagctacatgatatgtattgcaccatggttcccacgatgaatagaatgtgtgcctatgtattctcgtgttttaaattttctcacttttaagttctagtaccataaatattgatagctataacccacatacccaaaagcttttggggtccttgatgatttttaagaggtcctgagagaaaaaaattttgagaaccacttcctagagctccaagaaggtgaatgccataagatgtgtgttttttaaaaaagcatttctgggcctggtgtggtggctcacgcctgtaatcccagcactttgggaggctgaggtgggcaatcacctgaggtcaggaattcaagaccagcctggccaacatggtgaaaccccgtctctataaaaatacaaaaattcactgggtgtggtggcatgtgcctgtaatcccagctactccggggctgaagccacagaattgcttgaacccaggaggcggaggttgcagtaagccaagatcagccactgcactgcagcctgggcggaagagtgagactccgtctcaaaaaaaaaaaaaaaaaaaaattatcccttatataagtgaaagaaaaaaaaaaaagcattccagccactcagtgggagagattggagggattaggagcagatgatagggtattattttagggagctactacagagcttgggccagagatgatggtggcttccacaggatggcagtgagtgccctcactctgcttctggaagagaggaaggtggtgaggaattcaggatattaaaaggcagttgaggtgtacaggtcagtttagagacatataaactatcatgggcacagatgatgggagaaggatgaggctatattttctgccctccagacactgtgctgagtgctgtatctcctgcatcttcttaaggaatacactgtcttccttaatcctcctaaaagtcctctcaggctccgctgtccaatatgacgccaccacccacattaggctattgagcatttgatatgtggctagtccgaattgagatgtctgactatttaaaataaacacctgtgtttgaatacttaaggtgagaaaagggctgcaattattttcttttctttctttttttttttttttttttgagacagggtctcactttgtcaccaggctggagtacagtgggacaaccttagctcattgcagcctcaccctcccagattcaaggatccttctgccacagctccccaagtagctgggactatagctgtgtgccaccatgcccactaatttgttttgttttgttttgttttgttttttgagacagagcctcactctgttgcccggctggagtgcagtggtgcgatctcggctcactgcaacctccacctcccaggttcaagcattctcctgcctcagcctcctgagtagctgagattacaggtgtgcaccaccatgcccggtaatttttctgtatttttagtagagacggggtttcaccatgttggccaggctggtcttgactcctgacctcaggtgatccgccctcctcagcctcccaaagtgctaggattacaggcggaaccaacgcacctggccaagactgtaatttctttttcttttttttttgttgttgagacaagttttccttttgtcacccaggctggagtgcaatggtgtgatctcagctcactgcaactctgcctcccaggttcaagcgattctcctgccccagtctcccgagtagctgggattacagtgccgtcacatctggctaattttttgtatttttagtagagatggggtttcatcatgttgctaagctggtcttgaactcctgacctcaggtgatcctcccgcctcggcctcccaaagtcagggattacaggcatgagccatcgcacccggcctgtaatttcttatattgtttacatgtgcaataatattttggatgtacaggttgagcatcgccgatccaaaactctaaaatctgaatgttccaaaacctgaaatttttttagtgccaacatgatgccacaagtggaaaatcccaagctgccctcatgtgatgggtcacatatattattaaaaatattgtggtcgggtgcagcgttcacacctgtaatcccaacgctttgggaggccaaggcagcgggcggatcacctgaggtgggagttcgagaccagcctgaccaacatggtgaaaccccgtctctactaaaaatacaaaattagccaggcgtggtggtgggtgcctgtaatcccaactactcgggaggctaaggcagggaatcgcttgaacctgggaggtggaggttgcagtgagccgagatcgcaccattgcacccagcctgggcgacagagactctgtctcaaaaaaaaagagaaggaaaaaaatcttcaggcctgtgtataaggtgtataggaaacataaatgatttctgtgtttagatttgggtctgatccaaagatattaaatatatgcaaatattccaaagtctgaaaaaatccaacatccaaaaacattctgacccaagcatttcagataagggaccagaattattagattaaataaggtatattataagttaattttacctgtttctgcttatttttttaatgtgagtactagagtatttaaattacatatgtggcttgcattatctttctattggacagcactgcctaagtaactttttaaatccctacacccaaggaaacatatagattaagtagcatgctcaaagagtcctacagttagatatagtgccaggttttaacccagatcagtgtgaattccaagcctaggttctgcctacccaccagcagcctccctccatgggttttgagataggatgaggagataaagtgacaagggaagatacagagaggtggagcactgtaccttctttgaatccttgcaggtggacaggtagacgctgtggggaaagattgagaagggatgggatgctggagtggtagaggtggagggcagaggatgggtgtcaggctcttgggagtaggtggggaaagtccaccaacctcaggtcatggtcgggtagggctgacacttaccagcccagcccagtgccttgaagagcccaagcagaagaaagcagacaggaaaaggcctacgctgtcctcaagggagggccctgaaagacctggcaggcaaaggggtgagagtgagctcctgtcttcctgggtgctggctcagattccgcagagctcccgctcttacctgctacctccagggtgacctcagcgctgcgccccgaggcaggcaggctggatggtgaattcgacaggcatagcgtgccccatgctgctcagtggtgactgggggcggctcaagtgcccagagaggctgacagagccatcggaatggtggcgcagggccgagagccaccctgcccctcggccttctgagagcggccccctgggccaccccggagttcccactccacctcaggcccccagaagggtagaagtgggacacaaggcagagcaattccgggggtgcctccctggggcggcccgtgcaagggttgctggcatcagggacactttggggggttctggggaaaaggacgaaatgagcatagggaaatcagtccatactgtcctccctaagagaccctcagttgcctgctggcttcctcagaactaaagaaggttaggtttcttctcctgaaatagggaaccactgtctctccattggtgcgtcacagaaatacccatgtcaaagcccctcaaatttccagaaacttctagcctcccattacccctctaactcccaggaacctctttctatctctacttattgcccaggcaccctcttatccatcatccctccccctattacggtccccacaatccagtcccaccctctacccctggagacctctgtcccccaactcactgtacacagcaagctccaggtgacctgtccttgcaggtatggcaggtgtatggtggccagataggtgccctcctgaaaggttgaactgtaggcagccagaaggtcccatttccggtccatgggccccatggctcatctcatcccaagcagcaaatgccacggccccttcttgggctgctggcatctggccattcagccaggagttgcagccaggagcagatgtcccttacccaggtgctggcgtcgccactctagccaaagggagggggacccggagccagagatgaggcggcctcggaggtggggggcatgtagcaaagctcaagtccagcagagcatcttgtcccagtctcactcgaggggcaggggtgtggtgaggacagtcagtaccactgaggaagacagggagatgaggggttgggaggggcatgaggagagaaagaaggagaaaaaaatagagaaatgcagttattggggagggctaaactgcatttacccacccctcagaggacaccttttctgatactcaccatttcctagccctccctgcaactccttttgctctgcgactgggtggcacctagtgtggctgagggtgagcagagaggttaggggtggtgagtaggggcaatgagggggtatggcctttgaagcctactctgaacacaagcacactctagctcgggggactgcagaatccgaggccacttctgacacaacctgaaccctctatctccaagcaccacccttgaggaaccaggcctttcttgattacaggcgaagacatgattgagccatgactgtcagtcttgtggtgctgtacagaatatttactgactctagaagttccagctctagcctagacctgagcacagacctctatgctctactgaagcagtacagtcagtggctaagtgcctggagcctggctgaccgggttcaaatcccctctgcagcttattttatggccttgggccacttcctttttccatggctcagcttcctaatctctaaaattaaaattgatgataataatagtacctacttcatgaggttgttgtgatggttaaatcattaatactcttgctactcaagtctattcagttcccaattttagataacagagacacctacccatgagggtgcttacaacactgtctggaacacagtaagtctacacgtgtttgctatagttacactaacttagcataccccaagtcaacagcatctctgcaacattccccaccctgctccaatgccatcttccctgtctttgatgaatgatcaccaagcccgccagacactaaaagcaaaccctggagttactcagactcatttattcattcagcaactattgagcactgaagatgttcaagtatcctggtagaagacagaatggtgaacaagacaagcagtccctgctctcaaattgccttagtccaatgacagacaagcaaattgtcaaaaataatgtgctatgtgctatccccaccagacctaacagatctcacatctgtttccaatttaggttctcatcaatgtacgtttagacattacaacagccctcctgtctggtctccctattctcagtctctccttcaactccttcttccactgtagccaaacaaagtgactacaagtctgatcccatcacctacctgtttaaaaatccaaatatgggccagacgcagtggttcatgcctataatcccagcactttgggaggacgagcgggtggatcacctgagttcgggagtttgaaaccagcctgaccaacatggtgaaacccctctctactaaaaatacaaaattagcctggtgtggtggcacatgcctgtaatcccagctatcgggagaccgaggcagtagaattgcttgaacccgggaagcagaggttgcggtgagccggattgtgccattgcactccagcctgggcaataagagggaaaccccgtttcaaaaaaaaaaaaaaaatcccaaatacggccaggcgtggtggctcacacctgtaatcccaacactttggagcctgaggcgggtggattacctgaggtcaggagttcaagaccagcctggccaacatggaaaaccctgtctctactaaaaatacaaaaattagccaggtgtgggggcaggcacctgtatcctagctacttgggaggctgaggcagaagaatcacttgaacctgggaggtagaggttgcgtaagccgaaatcatgccactacactccagcctgggcaacagagtgagactccgtctcaaactaaataaataaataaaataaaaatcccaaatacctaggaagtcagctgataaaggataggctgaagctatatggcctgggttcaatttctagccctgcttctttttttttttttttttttttttttgagatagagttttgctcgtcacctaggctagagtatagtggtgtgatttggctcactgcaacctctgcctcccaggttcaagtgagtctcctgcctcagcctcctggtagctgggattacaggcgtccacaaccgtgcccagctaatttttgtatttttggtagaatggggtttcaccatgttgcccaggctggtcttgaactcccgacctcaggtgatccgccgctttggtctcccaaagtgctgggattacaggcatgagccaccacgcctggcctctagcctgcttcttacacactgtgtgtccttgggcaaattatttaactggtttgtgtcctatattatccatatgcaatacagggataatattaaaacctacaacctatggttgttgagaggaaaagtgagattatgcatataaagtgcttagaacagggcctggcatatagaaaatacttgaaaatgttagctgttactattttcattaccttcatcactatcatggacttgctggttaactggaaaaatcatttaacctgtattttcctcactagtccaaagatctgacctttgcctatttttaaaagaatcaagtaaaataacaggctttttccgggcatggtggctaacacatgtatcccagcactttgggaggctgaggcgagtggattacctgaggtcaggagttcgagagcacctggccaacatggtgaaaccccatctctactaaaaatacaaaaaaaaaaaaaaaaaaattagcggggcgtggttgtgggtgcctgtgatcccatcaacttgggaggctgaggcaggaaattgcttgaacccaggaggcagaggttgcagtgagccaagatcaccccattgcactccgcatgggtgacaagagtgaaactccgtctcaaaaaataaatatgtacataataaaaacagctttttagaataacacgccctccaaaagaacttctgatggttcgctctcacctacagacaaagcccagctttcaaggtatttgaacattcagcccctaacccacccttccaggcttccctgcaccctacaaaccagccacatagaacccctttcttgtgcctagtagaagtggtcacattggtc

SEQ ID NO: 5006 - DNA, 33931 bp, Homo sapiens
cgtacataatgaacttcaactgcaagatttgtcttaaaaaaaaatctgggccgggcgcgtggctcacacctgtaatcccagcactttgggaggccgaggcgggcagatcacaaggtcagagatcaagcccatcctggctaacagggtgaaaccccgtctctactaaaaaatacaaaaattagccgggagtggtggcgggcgcctatagtcccagctactcgggaggctgaggcagggaatggcgtgaaccctggaggcggtgcttgcagtgagctgagatcacaccactgcactcagactgggagagagagcgagactccatctcaaaaaaaaaaaaaaaaatctgaagccagctggcaaaatattagaattcagtggaactgggtgcaggcacacagcgggatttgtgctatcttggtaacttttcgctaccctttaaaaaaatgtttcattgctaaaattttattataagaacaaaaattacactaatattttaggaaaaaaaaccctatgaaagacatatggaagcattaccactatattctcgcttcaaaaaccccaccaactacaaaggaatgcgagataaaaggggcaagcattcatactggaaaagaaagagcaaatgcaaagaccttcttctgggagattcatctattatgagctcttttcatattctgaaaggcagcaacagttgcagggcagaagctgttgtggaggaaaaaataaatgttatctcctaagatagatttacccaccaaacttactaaccatgacattccaaaaacagaaatagcaaggcctagccagtaggtcagatattttttgatactaactccctaagaagtcagggtgaggaaagccacagtaaagctgtcttccttagaaagtccacaccatctgcctcctcgcccctcaacatggggctgcagaaggctgagcaaggtcagatgggctcagttgaggatagccaaggctgtgacttggtagggccccctggcttttgaactaaggaagggccaaaggcacagagcacagtcaaaaaccagggtggccagcacagaaaagtggtttgagggtgcaggatgggggaaggcaaggaaaccagacagtgaagcccaatccttgtcctcccttctgggaagacagtctgttaaaaagagcatgagctcaggagtgagccgacttgggttctaatgcctaattctcttataaccataactagctgtggcaacttcagacagtgagctaccctctctgagcttcaattttccatttgtaaaactgaggaaaccccacatcctggcagcattgctgagggatagagggatgatagatacaaataatgacaaagatatggtatagatatagatatagatatggatatagctatagatatagatataaaacatatatatagtaaaatgtggacatacaagagacagaaggataaagtatatataagagagcaggtggtaatacttggggtttaataaatggtactagtatatgttactccttccttccctccatacatcttactgactctctgagtcagagaaggctgggtcccttttctcttcctgcctctctagatgggtgtagcctggtcagatgggaagcctgctggaatctgggctggttagctggaacgtgtggtcacttagatccagaaaagcagattgtggggccagacaccaggttttaaggacacgttaaagacctcccagtgcagaccctggctgtgtgtcttctcatacatgatggcctcagtcaattattcctaagaaataattagccctccttaaatcattcctagatctctttaatagagccaaactatacacatgaacgaacccttccaaacaactataaagctgtaaagcaggtcaatgagaaaggcatatgggactcaccactgggctttgggggagttgcttcacttccctggcctcagtttccccatgcataaagtaaggcagtaacagacgacaatcaaattcccccaccattctttgtttctgtggactcgtaatcgtccccatagcaggcaaacacacatcatctgctgtcctagatagagtcttcagcatttaaaaataataagtgggattgacatagagctcccctctgagggactgaaaatatccttgaaaggcaggtactgaagatagttcctcttgtttatagagagagactaaaacccagagagcaaccagctcatcaaaaggcagtgctggagctaccagagaatccaagtctccagctcccagatgagacccaattctggcctctgcactttacactctgaccttctctactcagctaggagacggctagtccccatggccccctgcaacagggaaaataatctccaaagggacgggaatcacacctacctcccgttccctatggattaaaggtctctctggttcacttcaattatccataatcttccatcatgtctcagcaaataaatgatatttggcttatcacttctgattgggaaagcaaccccgccagggagatcaaaaacgccacctgtttccgtcaagcaaagagggtgtgcatattaaccagtgagtctttttaaattttctaagtagcttaatccattaaactggtccatcccgcttctacaatctgctcacacaggcaactccctcctgagcacgacgacaggccctccatcatgaggaattagctgacttcttgagaaatgatgtttgtacatctagaaagtgccagagttaagcagtgtttactgctggagtcccactttagtatgcatgtctgaatgatcgcagctttcagacctcctgagcaagcaatttactttgcaagagactatcaggtttggtaaatctgttttaaagggctgaaactgtgtagacaacctgtttggggtttccagattgcaaagggtagcctatgaaaaggtagcttatgacctccagaaaacgaagcaagtttaaaaattaaagatggattatagagcccttctcatttgagcagccctggagcccatacactgaattctattaccattactttccaagctcagggaattattacccaccctgtgcctcagtttccttatatataaaacagagattgaccagatgcaaactgacagtctccctgggtaatcaaagggctgttctgtccatcttggtattggagcaaagtgtcacagacctggaaacattagaattctcactgtgtatcactcacacaagaaaacctctaaagaaaaaaaaaaatactaaaattcagtagaagcttctgaatttttcacacattttatacagcatgcaaatagtggccataagattaactagggctcatttcttaaaggtgttataatcacgattaaagaattactatgatataaagactagatgtaatgtaggtacataacacgtatttcataagacaaagcattctaatgtagttacatgattaataattagaggaagggtgactgaagtgtaaaaggatccaccctgaactgaatacaatagaatcataccaggcgagatgaagaacagaagggaactgtttattaggaaacgatttttcagtaaattgaaataacgtgcccacagtgtgggtccagttcttcaggtgactccattgctccctgctaacaggggcagctaatatcaagacactggaagaagtcaaaggcctggtgaacgctgagaccatgattaaccttaaatacgtttgaggccaggcacagtggctcacgcctgtaatctcagcacttgcagggccaggtaggaggattacttgagcctagaagttcaagatcagcctggggtatatagtgagagtcatttctaccaaaaaaagaaagaattaaaaattagccaggcacagtggcatgtgccttaagtcacagctactcaggaggctgaggtgggaggatcacttgagcccggcaggcagagttgcagtgagccaagatcacgccactgcactccagcctgggagacagagccagacccccctaaaagaaaacaaggtttaaaccctacagtctgcatattcttcaatcccttgccatcttccggttcccaccaccatcactctctcctgaatctgtcttcacaaagtcaccagggggctcccaatcattgaattcaaacgttaattttccatctcttccttaggcacaattctgctgtttggatcagctagatcattccctccttctgaaactccattcccttggccaccctcacacatattcttctcttcctctgcctcccgttaacacacacctggctctctgatcattcctttcagtcatctcggaagctcctttccctcccttaacagccttcagagttttgctcccaacgcttaaacaagcgatatcttccctagttaagtcattttgtccactattagttggaccttacggtgataacttccaaaccaacaccgccaattcagttctcttcccttcaacgacatccccatccacccttggcttcacatttccaccccgtattgccaaagatacttccatccctggacaagctcagcatgtccaaaacagaatgttggggttttcttctaaagctgctcctcctgatcatgcgccatctcagctggtagaaccaccaaccatccctctccctcacccccaccgcatcaaccaactgatgctttcattaatatgtcccatccctgtcactcacaaccctagtccaatgcttctcttacctctttggcactaatggcttccttactggctttcctggctccagtttggcttctaaaagcatccttcacacagctgtagaacaaatctgaccacgtcacatgcttttcaaatccccattccacagcgggtaaaactcaaggtccctgggtcagcagaggtgcctgggtatcctggccagcccacctctccaggggttttctccctagtcccccaagacaatgacaagcccccactcggacctctcaacataacttatgcaaacctctatctcttcatttacataatgctccacaaatttctgttgggtgcctttcttcccccgacaactcatgaacaactttaaactacaggagggaatgtgttctaatgtagcccagagcccacaacagagtgtctatgaaatggagagagaaaaagaaggagggaaaaatggacagttgcttccctgtgctaaaatctataaacattttgtggattattccttcaaattaggattattcctccatcttgtggacatccctatttgcatgcattttaagattacagaactaaaacatgtctcttcacgctcagatataacttgcttattttaaaaggtaggagcgggcataggaaccaaaaattcatgtttttatcatattattttttattcatattattattttctttcctgagaaggctatggaccctaggttttctgtgaggcaacctttacctccagattagcttgagtgtaaaccagtaattcttcaggctcaaagtaaaaattcaaatgtagtccagtccttcatactgcaactttggcaggtaaagcttgcctccagaactccggggcacaaggactttgcatgtgataacatgtgctgtcagatcatctgacacagctgcccatagacaaacccagcattctgtgatgacccatgcccacaagccagctcacagggaatcaaggtcagacacatgttaaaggggaagagagccaggcccagtgcatccagcaggtgacaacgcctctctgagtcagccctctgtttctgctctgcactggtggcagaccgcctctcagtcacgcctccagtcctccatccacagagaggttgattcacttctccccatggtgaatcccaaaccattagcaccctaactttggcctttgtttctttcttatccagggaatagtgacagctgcaacacagtgtgatgggctactgtgctctgggactccacccagagcaggcaaaggcacaagccctttactactggagaggtaagggtgagctggcggaatgaaggagcctaaaggggttcagtcgaaagcttgcctctgttatcaacggccactaagtgctgggacccaggcccttggccaccccattcctggaagctctggtgtcctatgaaaatgaggccaggttatctacctatatggaaggtggcagctctccacatgacctggatgtaagagaggaataatggctccacacgaagcaagactgacataggaaatgccagcagaataagaaacataatgaaccagagtgccagcacatctccagagactctccctgtctctcctttgtcaatcaagtgcctttatgctaacaacatgagagaccatggtttttaagagacacgggcaagagattcagctttgcactgaacacccgcgataatcagctccaacaggctccaaccctgcctggcatggctcactttccagctcagatcacaatctaccccgtgctgcacaaatgaaatgcatttacagacagccggactctccagccaggaggaaaaatttcacctaattaaataaaacaaagcagaaaaccaaagccttcaatgccagaaagaagaagtacttggtcttttaagagttttatagccagaaatgcccatcgagatttttttttctaaatgtgtgttttaaaaaatcctctatgtccctaattggaactccttaagagaactgcaaacaaaccaagaaaaaatgaataaagaaaacgaacaagcatggcacaaaaaataaacatggctaataaatgaaaagtgcacagcctcactagcaggtaaacaaatgcacgtgaaatgccattgtttagaacaatggactggcaaaagttgaaaagatgagtactcttgagggttggcagggtgaggaaactggcccctcagaccctactggtgggagtataaattggtaccatctctctagggccatttgacacacctggcacaatttataatgagcttacctttggacccactgattgtatttctaggaattagccttagaaatatataaatgcagggagaaacacataaaaggctgggttttttttattatagcatcacttgtaaaagtccaaaactttaaagaactcaagtgtctataagaggagatggtaaatgaaagggatcttcaaagtttgtgaaaatgcatattatgaaaaaattatgcatgattttaaaatttttctgtacccaaataaactcgtactaacttgttataacatgtctgacaggatcgagcttgaggaactaagaaggataagacatcagtttgaaaaaagcccctattgagcaacatgaattctgctaaaactgaagcaagaacaaacatcaaatttatgatgaagctgggtgaagggatgatgaaatcactgatgctttacaaaaagtttatgggaacaatgcccctgccaaaatcagcagtttacaaacacctaactcattttaagacggggcaagacagtgtgaagatgaagcctgcagccgcagaccatccacatcaacttttgaggaaaaaattaatctgtttgtgccctaattaaacaggatccatgataaacaacagaaataataacccacagacactcaactggttcagcttacacaattctgactgaaaaactgaagtttctacctgatgaatccaaaactggtgcacccagaacagctacacagtagaacagagctttcaatggaaattttaacaagcgggaccaagatcctgaagcatatctttgaagaactgtattaaatgaaacatggccagatgtagtggctcatgcctataattccagcactgtgggaggccaagcgggtggatacttgaggtcgggagttggagaccagcctggccaacatggtgaaaccccgtctctactaaaatacagtcatggggcatgggggtgcacgactgtaatcccagctactcgggaggctgagcactagaattgcttgaatctgggaggtggaggttgcagtgagccaagatcacgccaatcactccagcctggagaacagagcgagactcaaaaaaaaaaaaaaagatgataaaatatgcttaatcagtacaatcatgaagaaaaagcacaatcaaagcaatggctaccaagaggtgaagtagtccagtcacagcgaaagttgaccagtcaagagtaaaggtcatggcaacagtttttgggatacttgagagctattttgcttgttagctttctggaaggccaaagaacaataatgctgcttattatgagaggttttgagaaagttagccaaagctttggcagaaaaatgccccaaaagcttcaccagagagtcttcctctatcctagtaatgctcctgctcaattcaactcatcaacagggcaattttttgagaatttcaatgggaagccatgaggcagcctccttacagtctggcttctgattttgttccctaatcctaaaaatctttcaaaggcaaatgtttttcttcattaataatgtaaaaaacacattgacatggttaaattcccagaaccctcagttctttaggatggactaaatggttggtatcatcgcttaccaaagtgccttgaacttgatgaagcttatttgaggagtaaagtttatatttttatcttttaattatgtctttccacaaactttctgagtcccctcctatgatgcaatatagccatactaccacatcagcctttaaaaagaattcagggttagaacgtactgacacggaagaatagccacaatagagtcagaagggaaagagcaagtggaaaacaatatgtatagcagaatcccatgtttgttcatcgctagagatgtagatgtatgtgtactggtatttacatttatatctgcacaatcttagaacacacactctgcagggaagaactgagaggtccttttagaatgtgggtatattttctattggcatcttttcttcagaacaattgcttaaagtgtcaccatagtaaatatgcctggagaacttacgaaagcggccaagagatttaggggagaggtggcatagcgctgctcattgtaaaaatacatacacacagagaaaatttgttcctttaacattaagaaacaaaacccaaaaggaaacagtcatcttactcaccaattacaaaatattttcatgaagcattccttaaagcacaagagaagtaagtttgggataaagtacttgatacagtcagaaactaatagtcccaaatgttggctcaaactaaaaagaaaactgaacaaggaatcacttggagaaacctgtgggtgactgcttattaatgagttagcataaaaatgacccaagggctatgtttccttttattcccttttagaacacaagtgtattctataaagctcttatgagccaccttccacagccacacttctcccctcccttctggccagccccctccccacaagaggcccacacctcagttgcctgggtgggatgcctctgactctgattaaggatgtaaacgtcattcgtcctctgcggggaatgtggcaggtctctccaaatctcacttccctccctgtgagctcacacttacagcctgctctggactcctatttccatgctactgggcttccaggtggcatcaggccacgatttctgctggaaaacagacgagctcattcaagggccctggaacaagagtgctggagtctggagcccaaggcttgtgggaggtcgggtcgccaagttttggagttgtccttgcaacccaagtgggtggagggttatcctacaacccacctcctgaagatgaggtggaaactagatctttttaacgtggagtaaaaggagccagacattcttgcagttcaaaaacagaagaaaggaatctgtgatgttggaagtcagaacagtggcggggggcgggggaggatggagtgggggcaccaccggggctctggggttggcaatgctgtacttcttagctaagccctggttccccaggtgtgtttacttcatggaaattcatagagctccccagtaacatctgcgcgctcttcggtatgtgcgttaagtttctataaaaagtttacttaaataaaagtaaaaaacatgtttttgaacagcacagctggcttatagacaccattcctctcctttttccttctacagcctgagcaaccagcaacctcactatcaagtccaagagttcacaatgcatgacaaggggtggggacggggacaggcaatgggggcagggggcgggggggggaatggctgtcccggatttatttttaattgattcactcattttctctgaatactcaaaacagccccctccttttctgcaatgcccaaaatggcacgagccacaccctgataaaccccaagcatgcaacttctcagacctggcgcaaggctctgcggtggcatctactgaagctcggcttaacagcagactctgggatgcatgcagaaaagtctacatggctgctgtcgcttcagttccaaaataatctgaacagggagtaggggactgccctggaagccaattccagctccagttacaatccactcactttccaaactcttctgggattattcttggttatcaggaatcctagggggttctcactgaacttttccacatggttcgtctgggggctccccccttcttttgtttaaacatttttatttgtctttggcaaaaaataaaataaaaataaatcataaagtttatagcaagctatcagagagaaaagcaatccagaataatttatgtttgatgagtctacagattagacaactgatgctgatttctgcctgcagccaagggagatgtctgaacctggctttcttcctcttttcgccgtaataattctttcaaaaaggcactgccctgtcatcaccactgcccagatagatgtcaggaaggagtctgaaccctgggagaggaaggctgatttcacctcgccagcaaagtttcgccacctccccatggcaggcgggaaaggagggagcaggtgtgatgggccacccagccaagggagttgtgactttaagagcactccaggcgttaccatcactgcaggtaccatgcacatccatactgcacccttccagccgcttccattccttgggcacaacagaagttatcatttccataatggtgttacacagcattttcattaaagcctaggctggtaataccattcctttgtattagtacacagctccatgccggtcatgcacccctctctctgtctatctgtctgtctctcttctcagatcagcttcttgtgttcccacaaaacagcttctgttcaaacttctgcccagacaactccatctccagacacctctccaaccccagtaaaaatcccaaacttgtgtaaacaccaaaggtctgctcaaagctcagcctccaagaacagggaggcgtggaaggaacacctcagacacacttgccaggcccaagaatcacaggcccacagttcagcaacaggacacacaaccaaaaccacaggaggaaaggtttcaaaagaaagaaccaactgaagacttttttataaagtactttttgaggaaaaaaaagggggtgtgcctgcaaagcctgccttaccttagctctccacaatgtcttcctgatcctagcggacaacacttatctatggggcagcagcaaaactggtggtgggaggcagaaagatttcaaggcatctgtaacagccactgtcaatcaccccagctagaagaaggaaaaaactcaggcacactcccctgggggtttgcaaactcctgagaagaaaaggaacagactttgtaaaacaccatccaaagaaatagacatcactcctaaagaaaatatggccatatataccatggaatactatgcagccataaaaaagaatgagttcatgtcctttgcaggacatggatcaagctggaagccatcactctcggcaaactaacacaggaacagaaaaccaacaccacatgttctcactcataagtgggagttgaacaatgagaacacatggacacagggagggaatatcacacacaggggcctgtaggggggtggggggcaaggggagggagagcatcggacaaatacctaatgtatgcagggcttaaaacctagacaatgggtagacaggtgcagcaaccaccatggcacatgtatacctatgtaacaaacctgcacattctgcacatgtatctcgaacttaaagtaaaaaaaaagaagaagaagaaacagacatcattccttcaaagtcccttgcatcagcaaactgctgagaggctaagaagccctgctaataagcacacaatttcagaaaaaatgtattattacccaactgcccttatgaatcaggcattatcctcagtactgctcaaagacaagagataagaacactcagcgatatttggaaaacaaaatatttctcaggttgcctgacaaataaggaacagcatttctatctctaaatataccaaatataatacctttgggcaagtgatttatacaaaatggacattttttatatttcaaaattaacggtaactttagaagtatatggaaatagaattgaaactgcataaatttccaacctctgctcccaaacatctgactttttcttttcaacttttccatccagcttttttccagttttaaaattcccagaagttcacatttgaaatacaatagtcctcccttttctgcagtttcgttttttgcagtttcagttaccctagtcaatggacttctgaaaatattaatggaaaattccaaaaataaaccattcataagtttgaattgtggtccaattctgagcggtgtgatgaaatctcgtgtcgtcctgctctgtcctcccaggatatgaatcttccctttgtccagcatacacacactgtctacactatctgcctatagtcacttaagaacggtctcagttatcagatcaactgcctctgtcttgcaatgtttgttttcagtaaccaattttatttaataatggccccaaagcacaagaagaatgatgctggtattcaggtatgccaaagagaagctgtaaagtgcttcctttaagtgaaaaggtgaaagttccgacttagtaaggaaaggaaaaaaaacttatgctgaggttgctaagatgtacagtgagaaaaattttctatctgtgaaattgtgaagaaggaaaaagaatttgtgctagttttgctgtacacctcaaactgcaaaagttatagccagagtgtgtgataagtgcttagttaggatggaaggcattaaatttgtaggtggaacacatggacagaaataggttccagttgacagcaattggtactatattcggtttcaggcatccactgggggtcttgaaatgtaccccccgaagataggggagactactatagaatatattaatcagaattcctaacccctagagactttagaataagaagaacaacaatctaaactgattaaaatcaatagtaagaaatcactttcgaagaaaaagcaaacttctatgaccgtgcctgccttcttccccacagtcatgcagttagactatgaatcaaacagtcatgatgctggtgacaggccgccactcagacttcccttagacgtgatgccgcattcgtggagcacccactatgtgttagagcctgcactggtgctttctgtttgtcattaatccacactgcatcgggtagctacttatacccattttccagatgaggaaattgaggttaagatgacaagccaggtaatgagaactagcatgcaaatcaggctctaactggctcgctaatctctttccaactgacctctgctatgtccccaaaatagcagaatagacctgttgatgagaatacataagttacaattgcttatggttctctctccaccctttcaaaggttataatatagtattattgagtattaaaaggtagcagaacttttgatacacaaatcccaaattaattaacatctgaagtgttgaaggaccacccaaatctagactacagcaatgaccactgtgttctacttctaaaattcctagccagtgacctcctcaacaatgacatttttcactgattggggcatggaacaagatatttatatttaatagatacccgctgcctatcgcatgctctgttttgtgtaagcactcattcaactaactgattcattcatttacccaaaaagaaagcattagacactactatactcaaggttgcagggaatacaagacttgagcacatcaaaaacctactattgacaggagagaagaagtgtgcacctaaagagctataaaattaaaattattttataattataaagttggaagtcataaatgccacagaagaaagtaagaaatggaatgtaagaattactaaaggggctgggtgcggtggctcacgcctgtaattgcagcactttgggaggccaaggcaggagatcacctgaggttaggagttcgagaccagcctgaccaacatggagaaaccccatctcactaaaaatacaaaatcagccaggcttggtggtgcatgcctgcaatcccagctactcagaggctgaggcaggagaattgcttgaatctcggaagcagaggttgcagtgagccaagatccaccatcacactccagcctaggcaacaagagcgaaactccatttcaaaaaaaaaagaattctaaggagggggaaatttattccaggggaagcatcatggaatgctgcatggaataattccacccaggccgctttgcaggttgggtatgatgcagacctctattccaaatgaaacgctagctaaatggaggcatgaaagcaaatggtcatggagaggaggatataagggtgggaaaactttaagtgccagactatagaacttggacttaactttatacacaaggagaagccaacatatccgtttttgagcaagggagtgacatgagatgagtaatgcttcaggtaggttaacctgcagccctatgtagaaagagatgggaaagaaaagtaataagaaaatccaatttggaagctttggaaatttttaggcatccatttgggaatcaaagagttgggtctatcttcactaattcaaaatatattcttcttctaataagaaatattatgaagggctgggcaaacttaaagtaaaaaatctatttagtctcttgactatttgctgaaggcagagacaactcaagtcatccatcttggctttggaaaacagcagatggtatttttggcagcagatccactgtcctagttatatgtttgctaaggctaatgctgtactttgtttgcatttcttctgcctgcaccattggagcaagggcaagcaatcctaaaatgtaacaagcaatacagagagctaccctgggcttcaaatttaacactcagatactccagacacaaacacaataaagtaggttatattcttcagtcccttatctgatagtattttttgaggcctgagcactttgtcaataattctgaccagtttccttcaatcttcaaaaccccaaagacaacaagcaagataaaagcaaggagtagaatccgatcatggtggctatgtatacaaagctggagaattcctgatactggttacagatttctggaaaactcttcgtaagaaaaataaaacaatctttttgaaaactgtgttatttgcagacctgccttttgatgtgctcttttccataatatgaataatggaaaaaaaatgttgcaggaaatgaagtgctcatagaattttctgcatggattgaatttctgcaactttcggtaagcaaatcagcaacgaacgaatggcatttgcatttcagcaacacccaatccacttataagggtgcatgacagtattatagtggaggtgggaaacccattctttcctaaagagtctaattttatcttcccaatccactttacatctttcagcataaacctctggctgggtggaaatccatttctattcggatgaaactaatttttcaggtatgtaagtgaaaaataatacaggactgtcttctccaatgctttcttagccttttgtaaatccaggtgaccaggatagacaaccagatcctgcaaagggagtcatcaaagccctgcctatgatgactgctcccagagcagggggtctaaactatggtttgaagcatttgatttaatactattaaaaggtctgtctcagagcaaaaaagggagtttcctggaagcactgccaagataaggaaattaactcttcaggaaagttccaggaagagaaaggtaaagtagccacagatatgagttggggaaaggatggacatttcagcagtatgaaatccattcactggataccaggaaaccaggataaaagtgaaggtgtgtacttacttgggccttgatccagagtgttggagaagagagaaaaaaatacaaaggagggagatatctagccgtgtctcctgtggagacaaaggaaggtaagagaatggtcaattaaagggaataaaaagacgatatatttattttcataaccaaagctgtaggagactgctataatctccacagttgtaatgctgcttaaaaacatgtttttaaaaataaggcctcagtggaaatcgaaatccaagctggaaagccacaaggaaaacaaggcagtacttcttccctgaacagcacagtttcctgtgaatacacaggaataagagcggattcatttcttaagaagacaaaacaaagacctcagttctcttgaatagcttattaatatttagccagttaaacatgggcctttcccagttgcaacttgccagcccaaaatatttactaggaattgacacaggcacatacagagacagataaaaaatatatatattattctttctcaccccataggactggaacacccaaagaattgcctgtgtatcgacaaaccaatcttgcaataggagcatttaaagttacgtttcttgaccccaacaaactcctgggagaaggatccctctccccagattctaaattcctccttatattttctcaagccttgaagaggtccaacaccaaataggaatgctaccgtcttccatgaaccctggagttgggatggaggaggtttccttgaggtacaactgcactctcatcaaagcacaatctgtatctaatccacattttaggcctcaggtgcacattcaaatggctttttgaaaaaatataggattttacccaatttgttacccattctgcctggtttgcgtccccaagtgttctttacaaatgacaaataatatgcctcctcacataaaaatggccctaatgataactaccatttattgggtattctccatgtgcggagcctttacaagcatctaatatttataacaactttaatcaaaagactcatttgctccttccacaaaggagaagaggccactcaggtaggctgaacagtccaccagaggtcacgtgggtaaactgagtgtctgggatttctacaagggttgggtctgcctaaactttatttcatctcactcaattcttttatctggccacaaaaacatagccatggaaaaatccaaccatctcaccccgcttcccagcacctgaactacaagcttacattgcagcctatcggattctcctgccatttcccctcagaaagaaaatttacgaggactgtactaaaatcactggtctgcagaggctcaaagtgacttctagttttaaaaactaacacgagtctcccccagagctgattattagggtgatgcagctcataaaatggaccataagaccatttctgttctaacagttttgtgttttcttttccagagtgctggctgaggaggactgctgaagaaatgccttcccaagccgccggtcttccacactcaggcaagcctcaggactgccttcgcctcttccctccctcacctttatcaattctctccagtatgcacaaaggaaacatgattaaccagcctccctaccagagggtgattcagatgggtcccagaagcaggttctaatttacttaagtgatgagtctctccagttactaatcctacaataccggccagtagatataattgcaaagcaggtaggctagactcaccaactgccaattcagtgccaacaaacattgcaaattacagggtataaatttagcagggtgggtttgacacacattcctgcgaattacaccttctctcactagtagaaagtgcattaattactcgggtgcatgtacgacttccacttactcggagctttctggaaagctatgagcaactcaggtaatccatgaagattaaagtataaataaataatgactgctggaggaggtgggatttttcaaagctcttggaatcagaattgttaactttctcccccacagactgagagagtcactgagcccactgtgtggggttggggacagagtaacccaggtcaaggcacaaatatgggaccagagggctgaaccttgagcaggatggtggcaatggagcagccatttcctccctcttgggctaaagtgcgacttcccctgcaggaaggggaatagtcgacatctggagcaaggcagatgcaccagaagtaaggtctgaatccacgggcttgagcccataaggcaatttcaccctgtgtgaaacagtggagcactatttatgcaccaggcactgagctaaatatctacatcctgcattgtatgggattgttcaccaccaccatgtgatggaggaaggaaccagtgctaagtttacagagagaaaactaaggctcagagagttcaaaaacttgcccaaggaaacataatcagacagtcaggaacccaggtctgtatgactctaaaacccacactcttaaacactaggaactgcagcagtatggagaggcagcgagcccaaggtgcccagtctgggattcggggagggtgaaccaccacacacatccattcagtaactcctacttcgtatgtgcctggcacacagctcagcgctttcctaaacctgttccatttaattctcagaacaactctgggaggcatctcatccccttgactcacccttaaggaaaccaaggctgggaaaagtcaagagcatccagctaatgagtagaaaaccaacattttaattcatccatatgcttcctaaagtcatggcttttcccctaatctgtgattaattgtaactctggtaactatggcgcccacataatttagggagaaaagaaggattaacagaatcaaactgctggggctagaggaaaacactcaatgatgctacccaccattgaggttctgagcccatatttcctgtgggatgaggaacgagtgggcatctatagtgggcaagggccagtttttgtttaagttgctcaacatcttagatatggtttggatttgtgtctctgtccaatctcatgtcgaattggaggaggggcctagtaggaggtgactgaatcatggggatggattcccccttgctgctctcgtgatagcaagttctcatgagatctgatgctttaaacatgtgggcacttcccccttcgcgctctctctctcctgccaccatgtgaagaaggtccttgctttccttcaccttctgccatgattttaagttgcctgaggcctcctagtcatgcttcttgttagcttgcagaattgagagtaaattagcccttttttcttcagaaattacccagtctaaggcgttctttataggagtgtgaaaatgaactaatacagaaaatgggtaccaggagtggggcatgctgtaaagataccagaaaatgtgaaagtgactttcgaactgggtaatgggcagaggtggaacagtttggagagctcagaagaaggcaggaagatgtgggaaagtttggaacttcctgagacttgttgaatgttcttgaccaaaatgctgatcgtgacatggacaatgaagtccggctgaggtggtctcagatggagatgaggaacttatcgggaacgggagtaaaggtcactctgctatgctttagcaaagagactggtggcattctgcccctgccctagagatctgtggaacttgaacttgacagagatgatttagggtatctcacagaagaaatttctaagcagcaaagcttcatgacctggctgtttctaaaagtgtatgctcatatgcatgaacaaagagattatctaaattggaacttatatttaaaagggaagcagagcataaaagtttggaaaatgtgcagccggccatgtggtagaaaagaaaaccctattttctggaaagaaattcaaccctgctgcagagtttgcataagtaaaatggagctgaatgttaatagccaagacaacaggagaaatgtctcagggcatttcagagaacttcacagcagcccctcccatcacaggccaggagggaaaaatgttttgtgagcagggcccaggacccagttgctctctgcagccttgggacgtggtgccctggtcctagccactccagctccagctaaaaggggccaaggtacagctcaagctgtggtgtcgagggtgcaagcctcaagccttgccaactttcacatggtgttggacctgtgggtgcacaaaggcaagagttgaggtttgggaacctctctctagatttcagaggatgtatggaaactctggatgtccaggcagaagtctgctgcaggggcagagccctcatgcagaacctctactaggcaatgtagacgggaaatgtggggttggagcccctatacgcagtaaccactggggcactcctagtagagctgtgagaagggggtcaccattattcagaccccagaatgtagatccactattgcttgcactatgcacctggaaaagccacaggcactcaatgccagcctgtgaaagcttcatgggggctgtaccctgcagactcacagaagcagagatgcccaaggccttgagagccaccttttgcatcggtgtgccctggatgtgagacatggagtcaaaggggatcattttggactttaagatttaatgactgccctgctgggtttcagacttgtgtggggactacagccccatttttcagccaatttcccccacttgaaacaaaagcattcacccaatacctgtatccccatgtatcttggaagtaattaacttgattttgattttacaggctcataggcagaagggattactttgtctcagataagactttgaactgtgaacttctgagttaatgctgaaataagactggggactgttgagaagagataattgtattttgcaatgtgaaaaggacatgatatttgggggggtcacgggtgcaataatttggtttggatgtgtgcccccacccaagtctcatgtcatttggaggagaggcctggtgggaagtgactggatcatggggcagatttcccctttgctgttttgtgacagtgagttctcatgagatctgatggtttaaaagtgtgtggcacttccccctcactctctctctctccctcctgccaccatgtgaataaggtgcttgcttccccttcgcctccaccatgattgtaagcttcctgaggcctcccagccatgctttctgttaaacctatggactgtgagtcaactaaacctcttttcttcataaattacccagtctcaggtggttctttatgcaatgtgaaaacggactaatacaacatccattctccttctactttatttgaattatcatttctcagtggctataatgtagtaggaccataggcagaggttctaccctttctagccaagggagatcatgtaatctaagctgaactaacatgatgctctgtccctggagagtgactcttagaacagggacaaaagcattccaacccttccaagagacaggatgtcacagggctcattttgctgtaagaccctatcaacattctctcactttccctccaagtccactcagcttggaactcacaggcctcctgactgaaaggactcaggcttcaacaggaaaggctgagaaaatacattaatatggaagaaaagcaacacaccccattcacagtggcaaaatctgtgtgtagtctcactgaaacagaaaagggtattagaacagaacctggcagcttccagatgtgacacacactactctaataggagatacttcctgcaccagccaggccaggtaagatcaggcttggccattgaagagtgacctgtcacagccagatcaccctctcatcacctctgatattgatagggcatttctctttatcaacagcatttggtggcttaattaaacttggaattcttgagcactcaaattatgacctcaatcctgacttcaggaaattgcacattctttgtcttaattggaaatgtgacggttttccctaacaaaatgtgatgataacgtaataacacatgcaaggttactctatagccagaaagctaagggataaaatgggcactgttgtacgggaaatagctgttcttacatatccatttgtaggatgcctgtgagcttctatggcataaatgccaccttattatttaggcatccatctctaattcttttctactggaaagtgggaagcaatgtggtaggtgtgccaaagggcccttctccagtgaagcaagccaggctaaaatcatttttgcaagctatttatcaggaaaacatttctgacttcctctgaccttgtccagttcgatgacactcactgtcctaaagccagtgaggttccagtggaccctccccagtccaggacgggcctgatgaagacctagtgtgacctgggtggctggtaagataagccagagttagaaaaagcaccgggagatgatgttagctggggtatcaatggggcctttgagatgatcgcacgtgctcctctccaggcaggacagtcacggaacagaatcatgcaacaccagctctgactctagtcgttgaagggatgatgaggacgaacaggaaggagtgacaacacatgcacaaagcagtgagctccaggctcctgacctacgggccagtgccaggcagctgtctctgctgcaagccattcaactctggaggaacaaagggatgggaatttctggggatttttctgatcaacaggaatgactgttaagtgtatgctagtaatactacaaacctgtcattcacagtgatgtttgtaacaacaaaaacctggaaacaacacaaacccaaaagcagggagtagttaaataacttatggaacatctactggattcaattcaatacgcaattaaaactggtttagaagaaatgcgaaagcaacccccctagacgaggagccccagaaaaggggccctttgtgttttgtaaatgttaattaatattagaacagagctgctcactggtctcaagtaacctaaaagcctattgttttcaacaacataaacgacaaaaaataaagctataattttaaaactatactaaccaaaagagttggggtaaaaaagtctgagtgaaaaccagttagaaatgcttttaatgaatagaaaaatgtccgctgtatataaaatttaaaaagaacttacaaattatgtgcacacacacacacacacacacacacacacacgtatacaatataacgaaagaatactatgccaacattttctgaatgataggattactggtgatttttattttctctttccaactgtattttctaaaacaaagaacaataaaaacagcaacaaaagccctttttattttttacgattgtaggggaggttaaagaccaccacagaaacaaactgccaaacagtagtcaaagtaggttgagctttgattctgaagcaaccatttcacccaaattattagattaaagatttttttataaagaaactactcaggtaaacatacatggagctcaataaagaattccctacagaatctttctgtaataagtgtcatcctagtttgtactttggaaatataatagatttttacatatcaagaacacagacttgggggagcggggagggatagcattaggagatatactaatgttaaatgacgagttaatgggtgcggcacaccaacatggcacatgtatacatattaactaacctgcacgttgtgcacatgtaccctaaaacttaaaagtataataaaaacaaaacagaatacagacttacaactgacaagccagactctaggaaatgaccaccttctccttgagtcatttttttctccaagctctctttctggctgtcatctatttttccaggcactttccgcgaaagaaagtaccactgaatagagagaacacacaaccctcaaggtatgggtaaaccattctaccacttcaacagccaacactccttgagtgtgaaggactcagtgctagggactccgcagaatctaaccacacatttcccatccttcccacgtgtctctgcttccctggggacccctgaagcatcccctacccgcccacctctggctctcaacccactctgctggaaccactacgcagcctcctatccagcctcctggcccccaagctccttccctctccagcccttcccacacgaggatgggtcatgtcaccatctccatgtcacgcgccccagcttgaagactcatggccgcatgaccaaggttccacctgccttcctactttcatcatccaggatatttcctcccaacaactaagttccagacaccccaaacaacctcccattctctagacataccgtttaacagcataaatatttcacacatataaagaaatatagttaacataataaatgctcatggaaccagacccaaattcataaattttagtattctgccatcatttcctatcttttttaagtaataaaaattactgagatggatggttgaaaagaccctctcacccatcttcctttctctttgttccttcccattttaaccacaatcccagtgtgtatctgctttacaactcattttctacttttacacatacatttcaactgtgtgtgtatgtgtgtacagacataaaacactatacatggtgtgatttatattatatatgttatatattatatatacatatattacactatatagtatatagctgtatacatatattacacatatatacaaaaatatatgctatataatatgtacatacacaatacacagagttttgtgtgcttttaaaataaactcaagtggcattataccatatagatcttccttttacctactctaaagtctccttagagatttatctgcatcgatgtgtgaggatcagcctattcattttcgttgctggatagcattccacttcatagtagtaccgtaatttattacccagtcccctgagatggataatgaggccatttccaatgtttaccactgcagacagactgcaatgagcatccttgtaaatgtctccatgggcacaggcagagaccttctctgagcaaaatgttgcatccacaggatgcaaggatcaccctgcctggatattactaggcctggggcctcatgagtaggtcaccatcatcccttggggaggaccctgccatggctgacagcaccacaggggcctttgatccaacaggagatttccaggaggccagtgacacacgtggagctccagaaagacaaagaggtgatacacccctccctttgggtcttcagaattagtgcactttgggttgccaaaggagctgaatggaagagcgtgagggagacttgggattgggcaggtcgtggacagaagcctggagaaagtagtgggtaggatgagaacgcagccgcctccaatgagaagccaaaacaccaagaaggagtgaatctgcaggcagcaggagagatgaggaggggcaggctcggtctggagaggcttgtggctgcagccaggcccctggagcagtcctgctttaaacgccgttttccgggtaatctggctgactctcaacagagaggacattcttcaaggatcagtaatgccacactaccatgaggctactccagtccaaccaactgaaggaacctctgcatcctcagggtccagcactttcctgcacctcttttataacatacattcggttctaggctgcacccagttaatgattgtaagtctgttctctacacagatcataaaggccccatgaacacacacattctgcactaacctgtctcccgtgcaataccaagcacagggctttttgcacacagtaggtgcccatcgatgtttcgtgactgaataaaagctgtgagctccttaaaagcagagcccatgtcctctcattgttatcacacatccagggctttacacagtgtcaggtatagagttggccctcattaatgtgtcctgaacgaatgactgaaatgtgggcttacatgaacaaatgcatctgcctgacgactctcccaggactcataccaatgatcaaatttcaaagtggaggtgaccaggccaaagataatttatctccctaaagacgctaagtgtcagttaaattgctctatttaatagggccgacttagatgggccatttcgaacaaaagcaataaccgctctagtaatgagcctactttaagtgctattactattactactccgaatccagaggattcctggagccatcagaccaagacctaattagagatctgcaaccttcataaaccacagacccctgggctcacatctttgacctcctggaaccacagaggatattttccaagtgaatccaggatactcctctccagaggttcatctaggactgttttttgttttgttgtttgattgtttgtttgtttgtttagatcagcctgccaacaggctctgagcatttcacatagctgagcacacaagcctgacaaagggtgaatatcttggctgaaaggagcctggcagggaaggcctcagagaatcaatctagaattaaatgtgggattctacttcatgggtgcatccaatgttcattggccactaggagcgtttgcaagcatagagaagagggaggaggaaaaatgcctttctctgccacaacagatgataatctctgacaacaacaagaacaaaaaacaaacacatattgaaagcatatgactaggaaatttgcactacaaaaatcagctcagagttccccctttaaaaaggaggtggtaaacacctcctcagcctcataatcccagggttagagaaaaaggaaatgaaagacaacacctgggggagtcccatgttacaggtggtgcaagcaccctcctccagtgaacgccctgaccctgtccctggctgccacctgctgagtcaactcccttctagagaagaccgtccaatctgaaaaggcagcaaaggcccaggccctcgccacagcctcttctagaaacccgacatcttcagccaattatcagatgacagcaaaagacaggaggccagagtccgacagacctgaactccagtcccagccccaccactttgagctgtgacccttgaattcataatctagttaagcctcactttcctgatctgtaaaatagaataagaatagtctccacttttggctttcggcttggaggaggccaaggtgcaactttatgggtcatcctgaatccaggttcatctgacaccagctgcctccagcacaccactgaagttaaccccaacaagatcaaagtcgtatacctgaggtgtaccttggataaagttgatgccattctgtgctggcccccaagattggccctctgggtatgtctgcaaaaaaggttggtgatgaactgccaaggcaaccggtgactggaagggtctaaggattatagtgaaactgaccattcaaacagacccagagtgaggtggtaccatctgccactgccagaagggtttctgcaaagccccaaggaaccacaaagagatggaaagaaacagaaaaacattaaacacaatggaaatatcattttgatgagattgtcaacattgcttcacagatgtggcactgatctttagccagagaacctctgaaaccactaaagagatcctgggaactgcccagtctgtgagctgcaatgctgatgctgccacttcatgacatcaacagtggtgcaggtagaatccccagctagttaagaagcacaaggaaaacatttcaataaaggatcatttgacaactaaaaaaaagaaacaaaagtttcccctaatcataaaaatagccatcattttatggcccattttgtatgccaagtgctgtatgttattactttattttcagccatccatcattccatgaggcaaggacatcactgtccttgttgacatgagaaactaaggcttagaaaggcagacactatattcccaaaggtacatggttaaccattcccaaagctgcatggaggagtccagacttgaaccaggtctgccaaagtttggcatatcgtacctactgtactgagatgttggaagaatttggatgagacaacccacactgtgccaggggctggcacatttaaccaaaaacagttaactgttattgttttactcattatgattatatttgtggctttgattcccttcatcatggtccttgctcctggccctctcaatcaggtagaacatcaattattgatctaaagaacagacctccactcgatatagaaactgtgcaggcaatctcattttgctgtgcttcactttattgagcttcataagtattatatttttcacaaatgaaggtctatggcaatcctgaacgcagtaagtctaccagcactatttttccaacctcggtgccacttcatgtgtttgtatcacattttgggaattctcataatatctcaaactttttattattattatatctgttctggtgacctgtgatcagtgatctttgatgttatcattgcaacattttggggcacctcaaaccacacccatataagacaacaacttcatcaataaatacagagctcttactaccccaccatcaggccgttccccaatttctttacctctcctcgggcctcctattccttgagacgcaacaataatggaattaggccagttaataatcctaccatggccctaagtgttcaagaggaagaaagcgttgtacatctctcactttaaatcaaaagctagaatggttaagcttagtgaggaaggcatgtcgaaagccaagacaggaagaaagccaggcctctgggccaaacacttagccaaattatgaatgcaaaggaaaagttcttaaaggaaattaaagtgttactccaatgaacacacaaatgataagaaagcaaaacagccttattgctgatatgaggaagttttagcggtctggagagaaaaatcaaaccagccatagcattcccttaagccaagcctaatccagggcaaggctctaactcttcaattctagaatgctaacgaggtgagaaactgcagaaggaaagtttaaagctagcagagattggttcatgaggtttgtggaaggcagcatctctgtaatataaaaatacaagatgaagcagcaaatactgatgtagaagctgcagcagttatccaaaagatctagatagctaagatcactgataacagtggctacactaaaaacagttttcaatgtagatggaacagccttcttttggaagaagatgccatccaggactttcatactagacagaataagtcaatgcctggcttcaaatttcacaggacaggctaactgtcttgtaagagctaatgcagctggtgacttcaagctgaagtgaatactcatttacttttctgaaatcctggagcctttaaaaattatgctaactctaacctgcctgcactctgtaaatggaacacaaagcctggatgacagtgcatctgtttatagcatggtttactgaatattttaagcacatgttgagacctactgctcaggaaaagattcctttcaaaatattactgctcagtagcaatcatctggttacccacaagctctgttggagacattcaagaagattaatgatttttaatgctgctaacacaacatccattctgcagcccagggatcaaagagtcattccaactttcaagtttatttaggaaatacatttttaaggctatatctgccattgatactgattcctttgatggtatgggccaagtaaattcaaaaccttctggaaaggattcaccatttcagatgacattaaaacatctgtgattcgtgggaggtcaaaatatcaacatcaacaggagtttggaggaaactattccaaccctcacaaatgacttttaggtgttcaagacttcagtcaggggagtaactgcgatgtagtggaaagagcaaaagaactagaattagaagtggagcctaaagatgtgactgattgatgcaatctcaggaacaaatttaatggatgaggagctgcttcttacagatgagcaacaaagtggcttcttgagatggaatctagtcctgatggagatgctatgaacactgttgaatgacaaggatttagaatattccataaacagctggcaaagcagtggcagggtttgagaagctgactccaattttgaaagaagttgttctgcgcataaagtgctataaaacaggcattgctgctacagagaagtctttcatgaaaggaagagtccattgatgtggtaaacttcattgtatcttattttaagaaaatgccacagccaccccaaccttcagcaaccactacactgatcagcagcaaccatcaacactgaggcaagatcctataccaacaaaaaacattaaaactgactgaggctagatgttcattagcactttctagcaataaagtatttttaattaaggtatatactttttttagatataatgctattgtacacttaatagactacaatatagtgtaaacatcacttttttttttttttttttttttttttttgagacaaagtctctctctgtcccccaggctgggtgcagtggcactatctcggctcactgcaagctctgcctcctgggttcatgccattctctgcctcagcctcctgatcacttttatatatactaggaaaccaaaaagttcatgtgactcctttattgtggtggtctggaactgaacccatggtatctctgaggtatggtaggctcccgaaccctgctgaagtacaggactgttcttcctcccatctctgctcctatatccacagctgactcctaactaatcagaagcttctctgttcctgagatgggcaccatttaccaacactgattccttaggggtgggagaaaagaaaacctttaaatctatgtgagtcctttaaaataacggggaaaacgtccttcctggagaagcaaatatttatgcacataattaactaaggaggtaggtgttctttccaaatcttaagcaaaacttggtggaaaaaaaacagacctgcttatgaaaggcctctcacagacactggaaggggccacacgtctgaatcagctcatgaatcctctcccattaaaaatataccactcatctgggctaacccaagacttttctggtacctcactccctatcctcatttactccagtaaaaattctttttttttttttttttgtatctctggccaggacgcgcagtcagggcacaattatctgatactgattccagagctgcaagagaacaccagctctcttttctccctaatgacttgtatgtcttttcttcattttctatgatcccctatcttaatttgactttcagcagaagggctagaagccagcaagccctaagtggcaggcagctagaaattctaatgtttttactctacagtcctgagaaaatagcatctatgcttgaaaaataaacaatggagcctcctcgctcagccagggcaatgcacagggtgtcagacactatgctcaatgcaaaatgtgcagccagcccttctctgtgccctgagcttccctaagcaattcacactatagtgaaggtatttataaggaggctattccttgctggtacttttttgtttacccccaaatttctcaatcttttaacttgtttttaaacactacccaacctcttagctagcacagtgaaatggagtcagaagaaagacccagtctgaagtctcaactcagtcatttataaattgtgtaacctgtactcacttcttaagcactgggacgccattttttaaatctgtaaaatggaaaggaatcataaaagtgtggattatggattcagtatcatggctcatgtccagacacttttaaagaaaaaatggaaaagactggaataaattagaatatatcagatatgaagggtatgttttgattacctttatataaatgttcttgtttgcaatgtaaatgtgatctttaacagcatgactaaggataaaactcacacactatacaatttacccattgaaagtatacaatgctatggcttttgtatatgcagagttgtgcaaccatcaccacaatcaattttagaacatttcatcaccccaaaggaaaccccatgcccattagcagccatgccctatttcctcccaaacccccactcagcctaggcaaccacctatctactttctatctccatgtatttgcctattctggacatttcctaaaattgaatgatacaatatgtggtcttttgtaactggcttcttttcatttagcataatattccaaggttcaatcatactgtagcatgtatcagaactttgttcctttgtatggctgaaaatatcccattgtatagatacactacattttatttatccattcatccactggggaacattgggttgttgccactttcaggctattatgaatgctgctatgaaccaccagcacacaaattgtgtgtggacataccaatgtgtttccataagtcactgtcaacaaagtttgatggcaatggctacaagattactgaggaatagttaaatcactttgtgatatttttaatcaactcatgaccttgactttggaaaacgaaataaagaccataaaatcaaggttgcattcttgttcatgagccacctggatctctgtggccaatactgctttcctactatcttgaaaaaccagtcattcagagaaatctaacctttggaacatgcatcttcattgtccaaaaagattgagacgggggacttccatgctcacaggagctgctgaactctcaggagaattcagtgatgaataaatttcttgtttaaaccaactcccattccaagatgtaaattcctgcatcatcaggtttcagacaaggatactcacaagcatacagccatacagccagaggccaaaactctgagcctcccctgctacacacacacacacacacacacacacacacacacacaaccattcaatttatgaactgcttgcatgcaatgtgactcctacaattgtagctatcgaaaagctgatgtaagaagagaggcatggtcaaaagcagctccctccaccagcaaacctgcattaataatttagctattaacagcatgtaaccaaagaagcttacgagggagagctctgcagagacctgtgacactaggaacaccccgtgcccactcccttttctattttctacttcagcaacagagacccagttgttggaaaagctgtcgccattggagaaaaggaacatgacaaatttgtgaaatctaaggaataaataaattcctatatgccttaaatttatggccctcacaaagcctaaaaaatatgataaaccatataggtttttttctgtcttccctggctggccgcaattaatttcaccatgttccggcatatacggaatgtaatatatggaggtaagacatttagagtcttgcagtgaataagccttctgagtttggggccccaggggtaaaagaagcaataataacaggactcattttgggtaaccattgtgtgcagtttctagtttgcattgttaagcaagacaaaagtgcccgaaggaacccacacagtac

SEQ ID NO: 5007 - DNA, 18561 bp, Homo sapiens
cagagaaaaggcaaattcagcaaactgctcaaagactgtctttcaccagaatgcaatagttcttatgtaatgaataattatttttccagtacagtaggacctattgtccattttcttgttttctttttgttctaattcctggctcaaaaagtactcatgaattagcagtatttgcaaagttgcacatggtgactgaataacattctgcatcattaagaaattcatactattctttttttctttttgacagagtctcgctctgtagccaggctggagtgcagtggcacaatctcggtcactgcaaccttcacctcctgggttcaagaaattcacctgcctcagcctcccgaatagtgggactgcaggtacccaccaccatacccacctaatttttgtatttttagtagagatgggtttcaccatgttggccaggatggtctcgatctctaaacctcgtgatccacccgccttgcctcccaaagtgttgggattagaggcgtaagccactgcgctcgggcataaattcacattttcttaaacttgtacacatgcagatttgaacttacatatggagtcaaattctcttctgttttggactctttctttgtgccaatttgccaatcagtaaggttcctgcgtatgagtatttaatataaaatcagatgggaccagattttcatagcacacccaactcagaaaatagaatactaacttatctaacatatctaccgaatgtgaaagcaatgacagtattcaaaatgctactataaggatacaacacaatgaaaacaaacttagaagtaaaaatagataacaaaagaaaaatttctttattatatttggaataagagtgcccatttttaacagctataataaaatataattacatatcatataatccactcatttaaagtatacaattcaatagctttcattatattcacgttatgcaaccagcaccacaatcaattatagaacattctcaagctgtcatctcccatcgcacaaccccctcccctagccttaggcaactgctaatctattttctgtgtctataaatttcctccgttccacatttcatataaacagaatcatacaatatgtgactttttaaattgcctttgtcactttgcatgttttcaaggttcatctgtgttgtatcatgtatcagtaagtacttacttatttttgtttccaaataatattccattatgtggctctaccatatttaatttatcattcatcagttgatgggtccactttttggccatcgtgaataatacagctatgaacattcagcacaagttttgtgtgaacctatgttttcatgttttcctttttcttacatatgtatctagaatggaattgctgggtcatatggtaactatgtttaaccatttgaagaactgtccaactttttccaaagtggctgcaccattttacattaaacatacttatttttgaggtaatacagatttcttatctgagatctcaagagatgagttactgaaagagagagaaggctgtaggaaggaaatgtgctggtatgatcttcatttctgactaaaggataaactgaaaaatggaaccagatgaattggttgcagttcagtctatacctctgctattcaaggtgtagtttacagactacagccttgttttgacctgagagcttgtgagaaatacagagtctcaggctccacccagatctctgaatcatagtctacattttaacaagatcctcaggtgattgtgcacatgaaagtaggcctgcacattaaagtctgagaaatactggtctagttagaactctagatattctacaggtataacatgtaagacagtgctggactacacacaaaagtgtgtgctcgtgtgattgaaagctgagtgtattctaggtatgcaagccatgtcctctgccagtcattttctccctcctcccattctccttcttggataatttgctctcattcctgcagaaagcatgcactctaagcccctgcttctctggaatatgatctcattctcttggtcaactggattattattattattatttttttttttgagagggagtcttgctgtgtcacccagcctggagagcagtggtgcaatctcggccactgcaagctctgcctcccaggttcacgccattctcctgcctcagcctcccgagtagcgggactacaggtgcccgccaccacgcctgtctaattttttgtattttttagtagagatgggtttcaccgtgttagccaggagggtctcgatctcctgacctcgtgatccgcccgcctcgtcaactggattctattggtaatggatattgacttgaaatgagacaaacagatatttcttggaattttgatcagaagaaagtgattctagaaagtctttattgaattattattattattattttttgagacagggtctcatctcactgtgttgcccaggctgtagtgcagtggcacgtctcagctcactgaagcccccacctcctgggctcaagtgttcctcctacctcagcatccaagtagatgggactacaggtgcatgccaccaagcccagctaagttttgtattttttgtaagatagggtttcaccatgctgtccaggctggtctcgaactcctgggctcaaacaatccgtcacctcagcctcccaaagtgtggcgattacaggtgtgagccactgcacctggcctttgtgaattattaggagaagagataaataacctggtaggcatgttttccacttcatgcacaggacgcaaagtcatctctagaaagagaaacttgaaggaagaagacgtaaagggaagataaagtgagaaagaaggagagaaaaaggaagagagagatggtggggacagacagagagagagagagaaaactagcattctgggtgtggagaggatttccgtcatacagattccacacttgacattttatttttctgtgatctatacgccagtgccttttttggaaatatatgcatgcactatcagattgacaaaaattaaagactggtaacattcagtattggtgaagatgctgaaaacgtatttctcatacattgctagtggaaataataatttcctttttaacacctagacaaatcactcttttccataacctaaaagccttaatcattatttaaaatgtttctatttaaatatttagtgaactctagttttccttaatcaacaattagaagatatattacaaagttttatacaatgttttaaagctccaacttatgtaggtgtttcactaaatgcaaaaaacgtacaagtagtttgagggtttttttttttttttttttttttgagacagggtctacctctgtcacccaggtggagtgcagtggtaccatctcactgcaactaccacctcccaggttcatgagattctccgcctcaacctcctgagtagctgggattacaggcacacaccgccatgcctggttaattttttttgtattttttttggtagagatggggtttcaccatattgatcaggctggtctggaaccctgacctcaggtgatctaccctccttggcctcccaaagtgctgggattttaggcttgaccaccacgcccagccaggtttgagtttttaaatgtagtgcttgatgacaaattagtaagttaatttaaaaatgagaaaggaaaatgtgtgctcagtggttttatatcacagtgcctttctctgtaatatctgtgaatcaaaagcagaacataaataggctcatttacttgggatatcaggattctggaaaggtaaagaaagacttttcaaatattttaattagattatatctgtataacacactggggccaatttccagatctctagaagggtttcaggaatttctaggttcaggcagaatttactatatatttttacattttactcagaaataacacaaactatgactcattagtttccaaaacaagtgagacataaaccaaggctctggggtctatttgtatcgtttaccttttggtagcctccttttcaacagcagcctacagagaaccagaggagaagcagaactgttgggatttgtttccacaggcttccaacaaatcctgcctctggtctcttctctagtcttaatcctgtatgtaaagcagctgaagggaggccccatgtagagctgagaatgcctctcttacagtgcatgcacctaggtacatctaaggattttagtgggtttccctctttgcagcctcccagaaggtgtagataatcagcaatgaggtagctgcactattaatcatggggaaaatttctacatattagtctaagttagtcccttttccaaaaagggcaatagggcaaatgtaggttgcaactgcaaccctcagattggcatccaaggttgattgcacgtatggtagggatcctaacaaaggcctatctgtgttataatcagaattctaatgcttccagtcttccagttgcactggaccagttgtattggatatgtcaattgacatagggtatgaaggaaggtgaaagtgcagcatactcaaggtcagctgtccccagggactgtgtctgagctctatggagaaagacaagcagagtgatgaatctttttcactgaggactctgaggcagagaaataaataagaactacttggaccaacacagagataagaggaattcttctcactctttcactggcactaacacacttgaaacattgttggcagagatattagtactctcaaggtggcaatcaaatacagagaatgtgaaagtattgaaggcagttttaggggcaatggtcattgatggatatgggtgttgaagctacatagtagcagatgtggtccgataactctgataaacgggttcatgagcacataggagacatcactaggggcttgccgtgttggatgaatatatgaagggagtcaaatgtcctgccccgggaatgtggctaaaaggctgggaattacaagtcaagcccaattaatgtgacttcatttgttatcttggatagtgaaatttcaggaaactggagctatgtacataattttcattgttttccatcatttgttaactttaagccctcatattaagtgtaatatgttatgtttcccttttctaccttcttgctgttttcccactaagggtcctgttccagcaagggactggaggcatgacatgaaggacaagattacatacatccatctttagcacacacaggtaccaagggtcctctctcaggtcggcatacctgtccattttaaccttccactcagaatacgtgtggtgttccttcccagcaccagatgtagtcctaatttactcagatcaaggtgagctagatcttcccctgaaacaacacttgtccattttgatccaatgaaatgagtttacctttgcagttggtgtgatttgtgtttccattagaggcctcttgaaaaataatagagattttgggccttcttgtctcttcctatctttacttaatagggaagactctttaacatgcatttggattgcgtccaggatggggcaaaaatggaatcagtgacttttatttctcataacagaggtcagaatagagaaaatgtgataaagcacaaaatttaacaaagaaaaggggagcagcccacccaccatcaaggtggagacaaatgtctgtgttcacgtaggtcaatggtagcaggtggcagatggcagctgttatccgaaccctggactcttaaagctgaggaaaaagttttgttctgttcaggtgattatgatagtagccagtcgaggttatttggatttggttcacacctgtgtaacgtttcatttatcagtagctagtctgaaagatttaaagtacagcaaaattccagatgaaccagaacactgctttatgtttatcatatttaggttatttattaatgaaaatatatgacattttcaggaatacaaattttcaccctgatgacctcaaatgcgtgcaacaagatgtttaatacagaaaataacacaaaaatgttgttacagtggttagaatttttaactttaaaaaaccatgaatttgtattgttttaatgcacaataaaataatgttgatatatacttaagcttaaattaattccaacaggcaaacatttccaacccagagtgtggctgatgctgggtcagctgactctattttggttcacaccaatttgatgtctaggctattcagcatctacctagaaaatctcaatcgttccaagcataccggaattttgtgatttctcagaagattttcggagttaaaagaagtgtttatatcacttaattccaacatttctaaaggggggaaaaccccaccatctattatcaatgacatttcccaagtcttgcaccaggcccttagtcaccaggttcccacgttttgttgctttcctaccgtctcaaccaggttcatgaaagcatttgaacagagttcagtcttcattttacaaaaaaaaaaaattctaatagtggctaaaatactgcaaatttctccattcgattacaatctacaaagataaacagcattcctttctctttctctcttttggttacttttcccctatccctactggtggaacattattttttcacacaggttttaaagaaatacattatgttggtttctagtgtattgtacaaatccattctcattctttacttgctacattatgactatgaggagggcagagtagaggtgactctctgtatacttgctgaaagtcttcttgtacacattgctttttgtacccgtcgctttagctatgtatcttcctgttctctgccctcgtctcaaactatgttgccacctcaattaacaggcacttgaattcacattgtgtagaatactcaaggttgatgatagactgggaaggagaggaaggaggcagagataagcgatgggggatactgagccctatttagactttggtccccagcttttggatgaacttagcacattactggctatgcaggactaacctctatgggatgcaaatgactccaagtatggaacaacattgcaaaaatggacttcaatattacatgaaggattggctgctttatataaatatagaaacaagcccagtggattactccactaaaggtgactaacaaatgttacagttcaaattgcactcaagaagtcaatcgagaaataattctatcaccaacccgtggacctaccccccaatctggtccctctcccagaactccttgggctctctcaagaccagcaattcaggtgttaacataaccctgtccagtggtatggccagtgtcttagtccaacttttgccataccagtcattacatattttgaataccaacttggtggaggaatttcagctcctttcagcagtagcctagtgggcaccacatctctattcttcattccccattccagcttatgctgaagggatgaggcttccagactccaaacccctctcagagtcttcatctgcttgtgcattttttcattcagctcctgaaggaatgccaagacatgcaaagcctcagaatctgctcatttttagaaagtcgcattttggcaattttttgcagtttgtctttcatcttttctttccccttgatttctggtttatttttacaccctctataaagtggtggatggccttgtcttcaacttcatttggtacagctgaaagttgccataccgcagatggagcagttgtttcgctacagagtaagctctttactgaattccttttggaagtaatactctgcttcttcatactgatctctagagcatggaggctggcaagaatggaacagacacggaagagattatcattggcctcacagctttcttcagatgagccacagcgtgtcctattagttccagtaactttcttttcccaacattccattctctcttagattcattacttggaagacttttgccctatagcagcacccatttggcaatgcaggtaggcattgtttggtatgtattctaaagcctttttaagcagttcatcgctttgtctggctcatcttttcttcgataaaacttggctgcactgcgaagaacatctttacacctggggctttctccaaggcttcttcaactaacttctctccttcaccttcctctcaccttcttcacgcatcttatgaagcttcagagccaggaggactttaaggtactggttgcaggattcagccgaatggcttgcctcagagggtcaatggcgttctgagatggtggccagtgtccagacggtagcttgctattgccagtccagaggtgaattctgggttctttggcttctttccagagccttctcaaagcacaccttcgctctttcattttggtttcctccacactttaccgtgtccacccttcctcacagtcaagctctggactctcaattctatagggactggaaacttctcacagacatgtttcaccttgtctacataaatctgaacgtctgagagtcggccctgtgatagtagacccaggcatagtttccccaggtgaccagacttctgatttctgcctggcagcatgctcttgctggattaactcttcagctttacgtaagcattccagggctgcctcgtttgccctttgaggtgctttagataggccagtaggttgcacattgtggctttgaattcagattctgaaactcagtccggtaaaatactttgtcttcaaaatcatccaaggagttttctcctccatcaagttccaggtgaaatggcattttagttgccgtaggctgctctccaaggaatcttattgttctcactgtagggaaaaacacaaagatggactttgagacacagatttatagtcaagaaatgggagcatggcaaataaaatgctcctcctcctaaaggctgttaacacaatcaaagaaactccccttcttttctttctataatatgtttttccttattgttaattcctgatgtggtagcaggagtttagggactgtgggcagcagaagaattagggcgagggcagtggttgttctctgagtctgtggctaggttttcatgaataagacagtttttgttaaacagctcgccctctctgctttcgagggtctctgtggaggcttggttttatttatgtagttttaaagagtaagtctttttcattgctgtttctgttcttcattcttccctagctttacttttgtacttgaaaatttcagctttataattttttattcttttaatgttttgccatggtgattttaattctcatccctccgaaatgcagcttcattttatctttgatattcttaattccttagttcccttcatttgcctttaaagaaatctttatcactttcgattttctgtctatttcagctttaatatatccttcatttattttgtctattcaaactttctgagcttttatcagattggtttattttgtattggtttattactttaacatgctacattctcatttttttctgtgaatttttcattttaaccatttgaatcttattttcaaccattcttaatttttactcattttatctgctttgtattattctctcatttaatttcaagtattatttatgttagcaatgtcttaaacattattttggaataaaatgtaattttttttcctcccctcccccccatacctctatttcttaactggtgatttctgttcttaacacatctcattgagttgctctattaataattttgtacttattgttttaattttttttttgaaattttatttttctcttctgggttttgcttttataaaaggggcaagaagtgcagctacagggaaggctcacaaggccactagctccttttcttatgaaagagctcttttttctttagggtacccttatgactctcctggaaagattttccattcctttagtgttggtcctcaaaataaataaataaaccaaaatcaaccaaaccaaaaaacaaacaaaacaacaacaaaaaaaccccgaaaaaacccagagaacagacaaatgagcaaaagctgtatttcgaattactttggagataaatagtattctatgccccaaattatttctcaacatgtctgtgtattggagtctctgtaatgttgccttttcttatttaaatttttttttcgtgtatctatacagcaacccttgtatcaggagctgtatttctaaatagtatggcttcttataaaccaatagatatctggaatgtcatgcaatgtggcaggatcacttatgaaacatatgtcagatagaagattatgtgacccctctttctaactgcccctctctctcccactttttatacactgcttcccactcccattttgattgggaatcttcctgtaacctcactaagaataaaaaagatctgtttggacatgagcttttcaacgggaatgcatctgccattaggatgcctgatacaagccaagcactctccggggctcccgcgcctggggttagttacatcaagggacttagaaacctggctctttgctaagacctatttggagctttgaatggaaggcgggtccttcctataactcctgcctattttccatcctatttttgtttgtttgtttgtttattctgcctgggatgttaagtctccatttgttccaagaaacagaggtgagcaggaactgatttaaagttactaagtgcttcacaggaccatgggtaggactgtagtgaccccaggaggatcagaacaggacatggggagcttggagggctcagaccctgtgttttctccatgtgcatctcagtcacactcttactgcattcattacagaatatggtgagtcctacagaatatgaccactctcagaccccagcatgtgcagcacgcatcctaacacctgaagactcactatagcttccttgctccctctcattctatttccaacttccagttgagtttgggagctcattcccttaacacataaactcctagctcctttctcattttacaaaagaaacagagagagtaaatagaattgaggttatctccccatataaaacataaagtctattgtgcatttgcaggatagagatatttaatatacacactaggtaaaagccctttgagcagccatttaaaaggcatccaacttcactgcttgattttggtttttatttccactggtaagttagagaagctgatgccagacacttgcttcctgggctcggcttgtgaggacctattctcccgattcctatagaagttccagttgtatacacaacaacacaatttcttcctttgcctcttatctggatgaaagccacagtgacattatcaaccaggccagaactaatgctaccaccgcagtctcagaatcactgaggagccttttagaaacacacacctcagactctaacccagacccacttaatgagaatctctggggagtcaaccctaggacttgtccttaataagctgtccaggcaatttttatgcatgctcaattttgagaaccactgtctagggcacaagggcaatgcccagtgaaagtcacaatagataaagaattaaggaaagaaagacagatgggtctgtattgtaatgggaaaaattctaagataagaccatgctaaaattctagaaataagaaaagggttctatagattctgggtgactacaaaaaaaagaaatctgtaaaatctcaaatcttttttttttttttttgaaatcaggcagaacatttagactagcaggaaaaatatcgtttcaagaagagaaatcaggaacctcacagacagaaggcaaggtgtctcatagaagtaagcacaggggttggtaacacgggattccagagctcccaggatgagggttaggcaccaggtccggccaccccaccttcaaactggagaaaatatttcccttcctattcaatgactaacacttcctctccagggcagtctcatgttttggggatagaagggaatgttagaggtagaacagaactattttctccaagcactccatctctaattcatactcaggaggcattttgggtgaaaatatttaagtttaccagcccttgtgcaaatctgagatgaagaactacattaaagtaaaattcacctttgcaggaagtggggtttgctattctgtgtatatctttaacagtactgctgaaaagaacccttttgttaaataattgtattacaagtccccaacttaatcctttaaatatgaaataagacagggtcagtgcacaagagcaatgcccccagacccatctttaaggaagcaccaggccgatgaaacatcatccctctctgctgccttctttctctgattgcaaccaactccccaggcgtgcagttctggagatgaatttaggaagcttgccagtgtgaagcagaaattgttcaggagggaacaaaccaccattggtaagacagatttacaaccaacagaggtgaggcatagtaaggctataaacaaacactaaaatggagctggccctctttgggaacatacttctcaggatttgcattggacaagatgactcaacagcactaccgaatacgaagggaaatatttacctcatggttgcagtgcaattctcagctgttcggcagggctcggttcaggcagtgcactcttcagaaatcttcctcttctgccaccaataaatgctgaagagacctatatatcaagtggcctctggttcctttttgtttgtttcccttcagctgacgttacaaaagggaaatgaaactagaaagtgaaattggcaggactctttttctttttttctttttattatactttgaggactctttttcctccggagctgagttgtgatcagagaaagaaggcagcagagagggtgtttcatcggcctggtgcttcacttaaagatgggtctggggacattgctcttgtgcacgtccctctcttatttcatattcgaaaagattaagttggggacttgtaatacaattatttacaaaagggttcttttcagcagatactgttaaagatatacacagaatagcaaaccccactcctgctaaggtgaattttacttttaatgtagtccttcatctcagatttgcacaagggcggtaaacttagatattttcaccccaaaatgctcttgagtaagagccaagcccagctgcgagtgagttagaagaacttcctctttgtggaatgtactgatggcatcaagggagcacaaccctaggaggacacatttacaaagctccctgccttgtgattaccatattaacccatctttctctgccttataccaatatgatccacaggccactgtaaggagcagttatttagcctcgaagggcaggggattttagtctgaatcattgctgaatctccagtccctgcaaaacaacctgacattgcatggtatggcaagcattccaaaagtagttgttgactaaatgaatacatgattgaagcatgggcagtgatgtctgtctatctggatttgaaatcagcttccacctttatgcttgaaactctggggaaaattattgaatgtctctgcttcggttttgtaaattgggaataatcaactactggtttattgtggtgttgggaggatgaaatgagagaatacgtgaaatgtcctagaataatgcctggcagtaataagtaaatgctagtttctattataattattaactaaaacgttaaccaaagtgatcagaggggaaactctttttttcaggctggagtgcagtggaaagtcctggcttactgcaacctccacctccctggttcaagtgattcgcctcagcctctcgagagctgggattacaggcacgcaccaccacgcctggctaatttttgtatttttagtagagaggggttccaccatgttggccaggctggtctcgaactcctgatctcaggtgatctgcccgcttggcctgccaaagttctgggattacaggcgtgagccaccacgcccggccaggggaaattcaatgttggctttttccagaactttatctcctctgacattcaacaatccatcacaatactgacctaagccaaacaattcctaacatctccttatgttcttggcttccccaagcccccaatattttccccctttttattgatgtataataatttacatatttatgagttgcatgtggtgtttgttacgtgcaaagaatgtttaatgatcaagtcagggtaattggggtatgtatcccttcagtgtttatcatttttatgtgttggtatcatttaaagtcctctcttctagttacttaaaatatacataatattgttgctaagtatagtcaccctagtcggctatcaaacattaaacttattttttttatttaacggcatgtttgtacccataacctaactctcatcttcccacaccccccttcccagtctctggtatctattattctattctcaatgtccatgagataaagtttttagctcccacatttcagtaagaacatgcagtatttgtcattctgtgcctggcttatgcatttaacataatggtctccagttccaactacattgctgcaaattacatgatttcatcctctttaatggctgaataatatcccattgtgtatatatacaatattttctttatccattgttcactgatgagcacctatgttgatttcatatctttgctattatgaatagtggtgtgtgaacatgtgagtgcaggtatccttttgatttactgatttattttcctttggatagacaccagtagtgtgattgctgggtcttatgaaaattctatttttagttttttgagagctttcatactgttttccataatgactgtactaatttacattcctaccaacagtgtataagagttcctttcccctgcatccttgccagcatttgttatttttttttttaataatagccatactactggggttagatgatatctcattgtgatttttatttgcatttccttggggttgagtgatttgagtattttttcatatgcctgttggtcacatataccagagctcctttataggtgatggatgcttttcctttgctgtctttaaaattttctttttgtcactgactttagatagtttgctataatgcgccatggagaagaacgtttttcactgtatctgattggggattgctgggcccctgtatctggatgtctaaatctcttactagacttgggaagttctcatctattatttcatacataggttttcaaaccctttcagtttcccttcgcctttggagatactgataattcattatttggtcaccttatggtgtcccatagatcgtgaagactttgttcatactttttaatttttttttttctttattttcgtcttattggattatttcaaaagacctgtcttcaagttctatgttttctcttctgcttggtctagtctactgttgaagcttcttgtatattttgtatttattcaaggaattcttcagttccagaatttcagtttggttatttttatgatacctatttcttggcaaatttctcattcatatcctgaattgtttctccgatttctgtgtattgtttgaatgtattggatttggaaatctcttgtatcttgctgagcttctttagtattttttatatatcatatatattatttttttattttttatttttttgagatggagtctcactctgttgcctagctggagtgcagtggtgcgatctctgctcactgcaacctctgcctccctggttcaagtgttctccttcctcagcctctcgagctgggattacaggcatgtaccaccatgcctggctaattttgtatttttagtagagatgggttttcactatgttggccaggctggtctggaactccgacctcaggtgatccaccctccttgtcctccctaagtgctgggattacaggtgtgaggcctgtgcttagtataattttgaatagtttttcctggatttctttttgattgggatctgttctggggaattgtattcctttgaaggtatcatatttccttgcttttacatgcttcctgtgcctttcactgatatctgagcatctaatataatagtcacttctttcaatttttgaatttgttttgtaggggaggactttttcctgaagatatatcaacaatattggttgagtaaggcactcaactttgattctgagtgtgcatggtagtgtagcctctgtacaatttatttggctgtgtcagtgatatatatgatttccttgatggtttagggtggggtttattcttggaggctatctgacattttactgggaacagggttgccatgtgggccagtcttcaggccccagtggtggcgcagtgggttgaggatgtctgatcttcggccccagaacaacatacactggcactggtgtagtgggaccaggtaggctaattcctgggcccccagatagcttgctcagatgctgatagtgcagcagtgggccaggtgggtgagtgggttctcaagtccctgggcagctgatgtgatctggcaatggcagtagccaacggtgggacaaacccttgggttctgataagtgtacactgatttggcagtggctgtggtgcagggttgccacctataccacagacacacagctctcaggcttttcattctctgtaatagcaaccccgcagcactgtgcagagagaggagagacgctgttcttaggtgtgagcctaggcacagaggccatgcgtccagtgggggtgcagtcaccactcacgcaccagacaggcggccatctggcttccctgccccagcctctggtagtagcatcagtggtgtgcctgcagcagtgtgtagaggacaagaaggggctctgctctctacatgtaagcccagcacacagcctgcttcactagtgggagagtatctcactatccacttgtgaggccgagtaagagtttgtggtgctgctaagggtagggtcacttctcacagccccaaacaggaggctctgaaaggacatgttttagtttcctttgtatcaggggctgtctttttggcacattgcaccatctttccctggggagtagtactccctgtgggctggggtgctgcggacactgtattaccttgggtctagccagtgctgtgtcactgtagcccactgggtggatactgggaaatatcactggggctcctgggatatggagatatgggagctgcggttcccaggataggatgtaattccagactatagtctcacaatggtgccgcttaggtcttgggggagctgagagacccagcgtgattccctgtctcatgaaatacccttgtggggtctccaaatcaccacccatactggtgtcaagtttgtatgggtagagaaactctctcatgtttcagattgcagcagtttgcaggagggagtggactgctgaagttctctcatttgacctttccctgaaatgccaaggccctctgttatctggccaatctcagccaagctggccacttgataccttcttcttctgcgccttgggtgttcccatgacttctctgttgaattctagtgttgtctcctagatgttctattcgaggtataatatctattcataattttggttcttctttctagagagggtgggtgtctgatgtctctagtagccatcctgaaccagaatccccaccatattttaaatccctgcttgttgccctggtattgacatccccaaatcacaatgtacagccatagtgttttgtaatgatagaagaaatgtatttccttattcatacccttagtcacaaagggggtaatcatgtatataggcccaaaagaaaaaatagtacctcaaagattgaggtcagaaaattacacaaagcacagatagaacacattctcagcaaaactgaggttgttaaggtaggttattcagtcttgggaaaagttatttaccatattttttttctgcctagggcagggaggaaaaagaaactatccttcctaaaaagtctccacctttgattaggatgcacagctaagcctgtcccagttggaaacccttacttttgtgtcttcgcaagagtttcaagttccttttctgtttacaagttcttcttcttctttttttttttttttttttgagacagtctcgctctgttgccaaagctagactacagtggtgagatcttggcttctgcaacctctgcctaccgggttcaagcagttctcgtgcctcaccctcccaagtagctgctacttggcccagctaccaggcccagctgatttttgtatttttagtagagatggggtatgccatgttggccagtctggtcatgaacttctggccttaagggatctgcccgccttgggagcactcccaaagtgctaggattacaggcatgagccacagtgcctggcttctatttacagttctattaggtacttacagaaatgtatgttaggtttttaagaaatgctgaaataggaagtggaaatgctgtgggtttggtttgatttattttttgaactcagtattcaagaaaactatggataggaattttaaaatcttgtgaataaaggta

SEQ ID NO: 5008 - DNA, 12233 bp, Homo sapiens
attatcatttcaatagacgtaaaaagagtttgaaaaaattcaatatccatttatgataaacatttcatcaaattagaaacaaaaggaatttccttaatctggaaaagtccatatatgaaaatacacagctaacatcatatttaatgttgaaagatagagtacttattctctaaggtcggaacaaaacaaggatgcagactctcactacttatgtttaatgtagttttgaagaacctgcctttgcaattaggcaagaaagaaaataaagtctagtcgcagatgacatgattgattagtagagtattctaacatctagtcacagatgacatgattgattatgtatagtattctaacaatctacaaacaacactattcacaattgttgagctaacttaggaaggtcacagactataagtaaatatacaaaaatcaattgcttgcttatacactaaaagctaaccataaactcttgtatgagagtggggccagttgacatttagtttcagtttaggatagtcagctaggttgtgtttgggacaaaccaatgttagtattttatatatttactcatgggctcgttagattcctctagaagggttttccagttgtctccctgcagggtaaaggtctggctgcccagtgtcctgaaatggggaatttcagcatccagtaagcatatgttcagttcatgcccatttttggttcaaaattatattctcaactatgcttgtaattccctgtacaaagtccttccatttgccctctccgaaaataaacttacagtcttttgctagggtgaaggaagagcttttgctgagcagcatggatagtaaagaggttttgagaaagtaactgcttcttacagtgcttttacccaatcattttcttttaagtccctattccttcaccctcttccaaaagcacctgttgctgctcatctctgatcctttgagagttctgtggcatgcaacacgtttggttttcagtgtttgctgttgctgaccaggatttaggcttgctgaattggtatttgctcatctgcccactttctagcttacagtagtttattgctattctctcttcctctgtgttcccatccttgtatgtctttttaaaaagctcctttccatctttttcatgaaataccaaatggatatttcatgagaaattgaaatatcaaatcactggctgatttaaaggaatgacattttatagaaaattaagttacatgttttcttaagtaatgcattacacttacataaggaaaaataattaagcatcttatttgtagagttgaggtaatagtgttttagatggaaaaattccattttggactagacaattttgttacctctattaaaacaactccagtaagaaagccaaaatattaactggtttggtcaatatcagtgaggtcttttcacttaattctgcctgttatataccactcatgtataccttacattttcatggtatttgaaagaattttggtataattgtagccatggccccgaggaagtaaaagctacattttcatgcagtgctaattatttcaacaaatcttaattaagtacttaccttgaggtaggcactttcctgctgctggaattggagaagtaaacaaaatagacccaaatccctgtccctctgagattctattctagtcagtagacttctggtattaaagtgagcataaagggcaccacaaaagacgttcagtgattcccatggaacagggtccctctgtttatacatatgggtatttcttatatgttattgctgtctgtgttcttgttcttgacttccgtagtagataggagtggcaaattgataatgatttaactatgttgctttgttgttgctattgtttgttcattatagcatctcttctaaagatgattcaaaacagattttcaagatatataatgtgtcaaaacaagtcaaagtagtctgagaactgattcagagtgagaatatgagtaggaaaatagaataaagctgagtgacacagtgtacaacatgcatgtcctgaagccctattccttgccaagatgacacatttttcgtgtttttcacaggcatcttaaaaatgaaaacataatcagtttccatgaattaaaaagacgccagagatttagtgatataaaaatacagaaagttctcctgtggatcttcataaggagtctttgttgggaaatgtaccaaaaaatattgttacaaaaaacacaaccaccagttccactgactatttcttccacatccttcctgtagtccaactacattagcacaaagcataatttttaagagttattatgccagatatctaaattagaaaaatttgaagccaggcacagtggctccgcttgtaatcccagcactttgggaggctgaggtaggcggattgcttgagcccaggagtcaagaccagcctgggcaaaatagggagtcttcatctctacaaaataaaaattaaaaaattagccaggcatggtggcacatgcctgtggtcctagctacttgccaggctgaggtgagagattcaaggctgctgtgaaccatgaatgcaccactgcactccagcctggatggcagagtggaccctatcttaaaaaaaaaaaatagaaaatcccaaatatagtcacttgaaaaatatgtaattttgcattctccatgtagttataataaatatactaatatttgcaacttatcaaatatttcatatgcattttcttctgagacaactttaaggcagctatcatatcatcatgatgcttatgtttcagtagctggttcttttttttttttaaagcagctttattaacacctatttcaataccataaaattcacacatataaagtacacagttcagcaatttctagtatattcagtttgcaattatcaccaaaatataatttttaaaggtttttaaacccccaaataaatctcaaatatcaaattagcagtggctccccattcctgcctatatgccccctgaccttcaaatatgcctagctccaggtaaccactaacctactttctgtatctatatggacttgcctgttctggaatttcacataaattgaatcataatatgtggtcctttgtgactggcttctttcacttagctaatgctttgaaggtttatcctttttgtagcatgcatcagtatttcattcttttttattctgaataatattccattttatgaatatatcatgttttatttatgcagtcatcagttgatgacatttgagtcatttctcccttttggctattataaattatgttgctatgcacattcttcagaaacttttgtgtggaaatatattctaattttgtaggctgtatacctagaagtgcaatgatgggtcattatctatgtttaacatttttagtaactgccaaactgttttctacagtgtttcaccattgtacattcacagtagcaatttacgagggcttcaacttctccgaatcctcccaatactagctattgtccatcttatttggctatagccatgctagtgggtatgaagtgaagctcattggattttgatttatagttccctaatgactaatgatgttgagcattcttccagtgtttattattgccaatttgtatagcttctttgaagaaatgttcatttaaatctttacaagatcacaaagatttactctgatattttcttctaggagtcttatagttttaggtattaatttatgtatatgatctgttttgagttagctttggtgtaaggcatgaagtagaggtccaatcttcttttgcatgtagataacaaaatttacagacaacaattactggaaagataatttttcccattgaattatcatggcacccttattgaaaatcaattgaccataaaatatgaaggttatctctgacttctcaattctactccattgatttttatatcttttttttaatgccagtcaacattgtcttgattactatagctttgtagtaggttttgaaatcaagaaatgcacgttttcaactttgttcttttttgagatagttttagctattctgggtcccttacttccatatgatgataacatcaaactgtcaatgttttcaaaaatgggcagctagaactttaacagggttgcattgaatctgcagatcaattttgggagtatttacttcttaacaatgttaagtcttctatctgtgaatatgggctgtctttccacttatttgggttgtatttcatttcctttaataagtttaatagttttcactatatataccttgcatttcttttgttaaatttataccttggtattttactccttgtgctgttatttcaaatgggattgttttcttagttttcattttaggatgttcattgctattatttgaaagtactattgatttttaaaagcatttaccttgtatccagcacattattaaatttgtttataattagttctttttatttcagcacaatattccattatctttttcctattaaggaacatttagattcttcccagttttcagacatgctgaataatgctatatgaacagttttgaacatgggtttttgtggacatagatactcatttatcatgaatattacctttaagtgaaatctctgcattataagcatttgtttagctttagtaaacgctgtgatcagtttagatgatttgcttttgtttctatactttggctatatcaatagtttgaattaatcacaatgacttctaactcattagtgactgattggtatttataaaaattgagaaaatggaaatactccaaaagactttatcattaacgtggtgagtcttaaggtgtgacattgatagaaggtaaaacaaagaatcagaataaggagaggagaatgtgtagcttaaaaaagcatattcatagattttgtttttgtagcataaactgtagaaagtaaaaattggaaattatcagggtggaaatcctgatttagtggtcatttatagacatggttaaaacagaaataacataccagctcttcctacctgcctagttttagaggtctgccctttcctctactatatagctatgtcttactgaatttgccttaaaatgccgcataagaagtagttaaaagacaaagtaatttaacttaatgtaaagaaatgagtttatagaagtaatttaaatgctattttccccacactgtaccatttgatgataaaaggaatcagaaatatgtaaaaaattaattcttccattaaccaaagaaggcagtgaggttaactttttcttgtttgaagaaaattctaacctgtttaggagaaccttgataggtggcccaagatctttttacatgggaacataaagaaaaaaatcatgaaaatgtattaaactttaatttaactaaaaataggtaaaactatacatttcaacattggcaggatttcgctcctaatgagaaatgaaaaggaagccaaatttgaagaaaaattgttaagcatatttaagtttgagtagtttgttttgtgggcactttatagaacattttgatttagtatttttggaacagatgatggattataaagttctttcttttaaaagtcaacatagttaacactgtaaaatttaaaagtttttttttagtttaagggccttatttttattaacatcatttgtatttttcatacatcttttcttaacattttctttggttattttagtatacatgtttattaccttttcatatgttaaatctataattctgtcaccttccttactttccaacaacctttctaggctcttattgcacctggtaagtgaagacgtctgggtttgaaactctgctcttgaaccactacttcattcatctctccattgtcactcttacaaaacctgttctctctcattaaaaaacttcccgttccagcactggttgtggaaggtgaccatagtcatagtgatgttttagtagttgagaggaatgtgggcaagttgctcaacaatatccacaggtataattctgagaacctggcctcccggggagctatgtggagatacaggccaaggagaatgcctgtgatctagaagccagcttgatgtcctgaagctgtactagttcaacccagccttctttcagaccacggtcaccacccagacccgctgaaggcctttaccaacccatgccacaccagcttcaccctgtgcaagcacatggcatccaagcgcatcaagaaaagcagctgatccaacagattttgtacctgggagatctgcggagacttgacacttccaggccttctggcaagccctggatgaaaacatgacccttttggaagtataactggctttgaaggctgttagaaaatttgtctcccatgtcatggatatcactagccggcatatttactgctggctgctggctgagatgctcggggatttgacagccagccactgaagatatggatgagaaaatatggctgaagcaccgatgagtcagggcagatcttcattgtagccaagaagaaagcatgaagcccaagaacattgtggagaagattgactttgaaaggcatcctggctgggtgcggtggctcacacctgtaatcccagcactttgggaggctgagggggtggatcacaaggtcaaaagattgagaccatcctggccaacatggtgaaaccctgtaccactgaaaaatacaaaagttagctgggcgtgctggcacttgcctgtaattccagctaccgggaggctgaggcaggagaatcacttgaacccggaaggcggaggttgcagtgagccgaatcgggccagtgcactccagcctggtgacagagcgagactccttctcaaaaaaaaaaaaaaccaaaagaaagtgcatccagcatcatggcctcctcctagtaactgcaggttttaataagatttgttgacctaggaaagcaaacaaaccaaaaatcccttccctctcttattcccaatcctctagcatctaccagagccttgctactttttttgtaaatcattataattaatgttctgatagcatcacagaaataatttctcctttgactttctagcttgtgggctttgctgattccaacttttggtgaacaccaaaatctgttccttcagctgtcacttctggagactgaatttcctggaggaagtcacatagtaattttgattggctgagtattccagaaggaagccatataactttctgattgaattcttctgtacatagagcctcagtgttctcataaagccacgattatttgacactttgttcacttccctcttatagcatgggctattgacattttccaatttcactcctaatttccacttgggtcccctctgtacttttctaaaataaggcaatttgtcaaccgcctcttgtctttctcaaaatctcttcacctctgcttccattctttcccttctataattcccctttttcccctccaaaataagttcccacataggtgcctttgatcccatctgctttttgcaatcctgccccatcattgaccttttttccaaggtcaatttcttgaactcacttattctttaaggaaatctttctttctgtaagccagtagttctcaattggaggtgactttacctttagacaatatttggcaatgtctacagatacttttggttgtcacagctggtatggggagtgctactgtcctctgttagttggggaccagggatgctgttcaacatctgcatggggaagtcctcctaacgaagaattatccagctcaaatgtcagtagttccatggtagaagaaccctctctaaacctgaatcaagcccaaattttgcttctccaacaaatttaaataatatgttttatgactatgtttacttctttgagttcttcatttatctcccacttttacactagcaaactctagagtggaagtcactatttctggcttaatttccttgctatacactcctatcactgaaaacacatgataatgttaaaaattgctacccaccagaaatcattaaggtccttaacagaccaactttttctcctgggtgcctcaaaatgacctagggagtgaagaaaacagatgggaaccatcctaacttgtgaatgaattcttagcaacaggagcctatgatactgaacttaaatactatttatttatttatttttattattttgagatagtcttgccctgttgcccaggttggaggtattggcatgatcttggctcactgcaacctctgcctcccatgtacaagtgattctcctcctcagcctcctgagtagctgggcttgcccagcttatttatttatttatttatttattttttaattgtatttttagtagagacaggtttttgtcctgtgggccaggctggtttcgaaccctgacctcaggcaatccacccccctcagcctcctgaagtgctgggattgcagacatgaccactgcacccagcctatatacttatttaaacatttgttaaggtggataaaaaattattttgctgattttttgtgctgagaaatcctcaacagtcgcttcttgaaaccagtattcttgagacacatttaaaatccaattgtggaaaataattttctaaaatacatgagtgtttttcagaataataaaattgattaaaaaatagtcaggctgcttgtacagatagggctacatttgaaggctgtgttgtgggcgtggttcctcacactgagggcatcgtgcttcttgaaaatgtcacaaatgctgcactcttcacgaagacaccttgctctaaacatttccttcccagttttcaggtttaataggataattgaatacatgaaaaaaaaacctcaaatttttagtaacatgggaataaccctaaattctttctctcccctgttactcacatagtcagtgggaggagttgctcagatactgtgcactcaggaatgaattcttatttccctccttagaggaaagatgatgaagcacaaagagcaaaatcccagacagaagcctttgtcctaatgataaagagtagcttgcaaagtggatttttctttcatagattttattttattttttgatttcagctctatctagaaactatcttatacaaatcaaactctgcagtgaaaatgaaacttgtgatgaaaagaggggctctgcttttgatgcattagttcttataaaaattaatcatcaacttacttgttttcactaaaaaggcccttgagagtattcccttaaggaaataaggagacttactagagactcagatctttttgtccatttcataacccaagtggcatggactcttaccaaaaagagacagtgaaactttttgaaaagtaacctgaatgtaaacaatctaactctgttacattccatttttaaaaaacagcagtcaatataacagcatcttatttatttgccagtgatataggtagggaaaactttgtgatgaggggcccgactaagttggtggaagactcttgacagtagaggttatgagcttggactacatcaagatagcagtcaaaccttaattctaaaagtgacacatgccattagtattggtgatttgtataattttcccacatatagaaatgatttaattcacaatctcatcttctagaagttggcatataactctttgtactgttttcaaggaatttgttcagaaagtgagaacatgtttatgaatgccttcaagtcatttaccataactattcaaagaaggaatgataaaatttatgaggacaatttcagttctctctaaattattcatttttaaaaattcaaaatcaagataaaaggaaaatagctaaagaaatccaacagaattcttgtttgacagtaattggaaaccagtgttggaagcagttggtgcaatatgttctacaaaggacttttttaattttatttttttggtgctttcacagctcttcaccctttcaatgctgcttaaagaaatgcaagtgccaaaaatgggctgaagaactttcctagctggacagaaaagttttgaaaagagagctgcatttttaataactaacttatatcttattcaaattttaggaaagaatcctctcattgtgagtttctttttttctgaaaataagaaatgactctagaagaaaatacaatctgtgagcatgattcaaggatttcttgccacccatgcctggttctctgtagggctaaagtgatagacacatgacaaaaggaccctcccccacctccataatgagcagccaagcttttactcttatggctctttgtttctgggactagaggcaaagggtaccactttcaggctagcacaactttcttcccttctgaacactccctactccacatcctactatgttctggcagatagagtttcaacacgattgtaaagagctaggcatccctttggaatcctagaaaagcagaattgtgcaggagaatgtcactcatttggttactaccccagatctgtgaggggaaatggaaaaaggatgaagtctcctactctatttttccattcttttaaataagggattctgtcttatttaaggacaaagcatcattgggcctatggtttttcttcaactagttccatgagccttatagttagaaatatattcctaatgctgccttagataagttgtattaattttcagcattgttataagatctctggaacttcaaagaatttgagttggaaagcgaagaggctaactcaacatgcttttaaatgaaaaaacctaacttaccagttttcacattaaagaaatttatgtcttttggccacacacacacaaatccaccaatattgagtgttgaaattggaattttcatgaacatttaaatcagatccatattttcaatatgactatttttctctttttcatgggcatgtcatcaatactgtgaaaaccctaaaggagaataaatggagaagcatgccagaatcacacgtgatgttgaaatgggttctaatgcttttaagattttactgttcctttttctcatatttatcccaagagtataaaagttcagtgaaatctttcctggggataaactcttttgtgtttttgatctatagcaattctttgtaattttgttaataaagtgtgtggtaatcttaatctaatacaaattaatattttcatagttttccagtttgataataaacaacacaaatatgttctacctcttatattctgaagtttgagacagggtttgttttgttttgttttgttttgttttgttttgttttgagatggagtctcgctgtcgccggctggagtgcagtggcgtgatcttggctcacttcaacctccgcctcccgggttcaagtactgagagagttttaaaccaaaaaagttaccttcttagtggccaatgattatctttataattcttacagccaggtcttgccttcttataatcaccaataagaacatagacttaggagcgggtactgttacttaaccatgagtgaatatttaagttttctaagccttagctttctaattgattagatataaaatgtaaattataatatctaccttatgggtttcgtgtgaaatttatgacttatctagcatagtgtttaccataaatgaatattcctttaaagttggatattgttagtgttattgtccttaggaattacaccaaagaccaaatgaagttttcttctgattgtatgcttctagaatatatatattttctaatcaaatcatactacatactaataagctacttataactgaatcccataagtgtacactgaatcccataagtgaaaaaagctaaacctgacttatttgttggggatggtcttggaggagacttagaaaatcataaaataatgcctgcacttggatcttagataatgatgaccaaattgcaatgtgttatttgtcctatattgagaatggatgtcatatagcttttagaaatatggcaatcaatagctgtggaaaaatatttttccatcctaaacaattaggaccatacagtataggtttatataacatgaagttgggattgtgtctttccagaattttaaacatctagtgtccactggggctcatacctgtagtctcagtgattcttgagctaagactgaggcaggaggatggcttgaggccaggagttttaggctgcagtgagctatgtcacaccactgcacaccaacctgggtgacagattgagattctttatctcaaaaaaaaaaaaaaagttcaaaaaacccca

SEQ ID NO: 5009 - DNA, 15179 bp, Homo sapiens
agtagccaggagggctctttgtgctctgaagattctgggatggaagaagggctgagtagcagaaacactagccacccttataaggtttctggttctttgcactagctattagattacagcagtctgatcacagatcatgtctttttccttaccagttaattatttgtttccccagttttatttcaaagtttaaagacctggttgcaaggcttgttgcaaaacagaatcagcattcccctttcctttccttggaggtgactagtaactctctgaagtggttcttttggttttgcttcacaaattggagtgacatctttctattcctctatttggtttttcagttacaggcattgttacctagtccgatcattgagatgattttgatgtctttcacacccacccacactcctaccaacatattcatcctttctatcccctcatgttgcctgtaaattatatcagtagcattgataggtcaatatttaacatttacacgatcctgagtatgtaaactctatctctagccaagctcacctgcaccactttgtattctccttagagttcataatttttttcccatggaaatttttcttagctgggtagaggccatctcactagcatacatctttgttttatagaattacacatagtctgaactcgagatttcacccccatgatttcaggttactcacaccctccaaaattcattgtttttcattgtattttataaaatagttacaagtatggcagccatgcggttgaaaacattttaggaggacctatagttacagaaatgcatcaaatttggtcattattttaaaaatatgatagctacctcttcaacaatgtagagaaagcatataaaacagcatataaaatatttctaacttttaactatagtgtcttaggatcaagaggtatgtatgcttattgcaaaatttggtgtttctaaatattaaaatcagcctaatgcttgcaatgttgaaataatgttcaggaaagaatcctaacagtggttctcaaagcatagtttagaacagcatcaatctcacttaggaacttttagaaatgcaaatctccctcccctttaatgagaaagagggaaaggcggggagcaatcttgttttagaaggcctccagatgattctgatgcagactggagtttgaaaaccagtgtcctgacaaacattgtgtaagttagggatcatgtccagctgttagtaatagagacttgagatgcagtggcttaaagcacataccaagtttttccttacataaaaggagactgcaggtaggtatcttggatgattcagatgtcatattttcactctgtccctgccatataactcccatcctctggttttaaaatggttgctgaaatttcagctataacaaacattctaggcacaggaaaaacaagagagatggggagaaggcaagctaggtaaattaccttccaagcgcactctcagatgcccacccagtgacttaggctttaaactcatttgcccaccaccccatagttgaaagggaactgggaattaacagctggtcacattgttgctcagaatataaccagggatgccagaaagatggatattagaaggaactagcaacttctagatccttcctggaatggagtcagtcatcaagttaagcctttaagaacattattctgaaatagctctttactacccatgcattaaaacacatcttttatctgctagaggaaaaactacttccttgttttaggcaaaagtcttggcttacttgagaatctgaagagccatttatcagaataaatgaatacaatttcacataagtagaggtgtagttgtatacatcaaccaagcatcctgcacagtttctgagaagttgatttataacaacatacatgaaaaacaatcaattaaaaactccattctcttcaggattataatttctctctggaaatgcatcataaggaagtaattcaaggagaagctgtacgaacaacactgttcatacactgttatttatgacagcaaaaaaaaaaagtagtttacaattcaaatgtcctacagtaagtagaggctgagtgaattgtggtatgaccattacatagccataaagaccatgtagcaaatggcagagtgattgtaaaaatattggcagtgcgggcaaatgtcaaaacacgtgtatgtgataagagcattcagagaactataatgcttttgtcaggatgttagaattatgaatatactggtttctgtttaatttcctttattgttctatgagaaacaacaaagaacaaaacaagaacaagaagaacaaaaaaataaatttacccaggttcctggccatgattttccctgagattctttctggctgtttgtcttatgcatgattcaaccgagggtgctccaggagggcgtgctttctgctctgtgggaaggttgtatgtaaggcccgatgaagagtcttcctgtggctttggtggtccacgtgggttaacaccctgatcatctgtctctgaagccgtttgttttgcatcaccaattttttttccagtactgagaacaaatttacaatcatctattcattctctcttgccacatttcctcataatcagtttcatgtaactagaagccaattgtcccaatttaggtgtagattgtaggtgccaatgggaacaaaaaaatatgaaacttatgtaggaatcaaatcagtctttatatgatgctgtgtatagacctgcctcaccaccactggcaccaaaaaatagtcccctgttctgaaattactgtgaatttgcacagttgtccagcttggtaagagctagaattaaccttagttgagtatagtgtttatttttttaggttgaagattccccaaatgccccaaattccttggatggattgagatttgtgagtgaaatatgcaaacccctggcatatctacatactgggtagctggtgactgttatgggtttagaaatggtgaaagaaaaatggccagggagcttctcaggggtgggggttgatgataacaaatactcagctcagtagagctgggagaacagagcagaactcatcaggaatcctccaccagcaaggcctggggacactgggggtgtctgcgtgctcacaccaaggcaggagtccttcaaagaaagggaagaatcttggctgggtgccttggcttatgctgtaatcccagcactttgggaggatcacgaggtcaggagtttgagaccagcctggccacatagtgaaaccctgtctctactaaaaatacaaaaaattagttgggcatggtggcgggccctgtaatcccagttacttgggaggctgaggcaggagaattgcttgatcccgggaggcgaggttgcagtgagccgagatcgcaccactgcactctagtctgggtgacagtgcgagactcatctcaaaaaaaaaaaaaaaaaaaaaaaaggtagaaagggaagaatattgattttccagaagtgagggacctgagataaaaagttcaacctaccctattgaaaactacttccataaataatcaagcaaacaagagtatttatcttattaatcttacaggagaaaccaacctgaagtggaggaagacaggtaaatcctggaagactctttgagactttaccaaattaaatggcttagttcatgtgcctatattgtgtataatacacatgctgaatttcttttacactgaagtgaataaactctgctctttaaataaggggcaagtgccataaactgaaagaatctttgtggggatcagcaaaaccagagaaaggaaagctcataaagtccaagggtttgggtttttggagcacttttattttacaataccagagaatcaacatctagtagtagcataatacaaaatgaaacacaatctatttaaaactcatgtaatgggaactgtatttcaaaaatgataagaaaacaaaaaggagatttagagaccagtcgatataaatgtataaaaagcccccaaaactctcatttcacatcagtgcaaacaaaaatcatttataataacatacatatgaatacattcacttacactacaaagtggattatcatttttattttccatgaaatatgtcaaaatatatgcaagtatatttcacattctgatgggcaagataaatcttcaaattaaaatatgtacatttcacttaaataaccaaaatattaaaaatagcagcaacactggtctttaaacacgtctaatatcccaagaattgttcacacaatatagactattttggtagctctttcattattaatattatttaatatcacatacagtttagaaactctaaggttctggtctgatctctgaataacttaaagtctagttcaataaatacaaagaataattataaaacacagactgcaggacattatcaagaccaggaggaaatcatacccaaaggttttagggaagaatcagatatgaaggcgtacaggaaatcttaggatttccaaggcaaaaaggtgtgatctgacaagctccctgatatgttaacagactggtccagagaaatgtgtgaatgtctcgaaggcactttctccgcttcatccttccatgttcctttgaatacggcatttaagtgatgaacaactttggaaatttcccaataaacaggggatgaatcatttctcaccaggaggcaagacagtggatcaggaggttatttgtttttcagcattacgtttattctgatgagcaaaggcataaaaaccaagatttcaacaggatttcgtgtattcatcctagatggtgggaaaagtatttgtagccccattctcaatgtgtcactgtaccaactgtaaccctattggcttagaaagaaaccccaaatggggttacaggagtttcctcagattggatttggttacagaagttgcccctgtgactggggactctctttatatttcaatagttttcagaaaaggtaaatgtttaagcctttcgatggggttggacctttgcctatactactaaggtatcactctctgacattgaaatgtcaatagtttgtacctattttcaaaccacttcaatactatttcaatcgattctcccaaaaaaaaaaaaaaaaaaaaaaaaacacttgtgtggagcaaggataggcatccaagtgctcatttcaaagatctggaaaactgaggttcatagagccaaagtgacttacctgtccacagtcgcacacgagtgaactggtatggatcttttgcagacttggctctatacaatgtttacttattttgaagaatggggcttggtaatagttatttcaaagaatgaagtaatttgaagggggtaaataaaaagggagaaaaatgagttcaagagaaaaagggagcgagaagtggtgtcagttggcagttagtattatgaactttaaaatgagcaagtgcatttcacatttagaacacagacatttaaaaaatatgtaatacttaaatcttccaattgtcctattttgggctagatttactacatctttaaatataatatctgaggctacattttatttactgaggctgccattgagacatatcatgaccaagaaatttttacatgagttctaaatttcccaagagactggtgaaaatgttattgcctattctcagaaccccattcctacccattttacttccagaacaattccattatatatataatatatattcattatatgttatatatatatatttatatatatataattatatgtatatataatatatattcatatacaatatattatatataatatatatatttatatatattatatatgtaatggaattgttctatatataaatataacataaatatatattacatatatataaaatatatattatatatatatatttttgctcattgggtggttttctcaagtgtgggttttagaaaatatccttaatgaatattcttgtgtgtccttaggaaaattagcttttttctctctggaactaagctgagaaaaagactgcagaaacttagagcttttatcactttaaatctggattccagttggacagttgccagagaagaaaaattttaaatgactatacaaattaatttagaaagctgtcatatttcacacaacctttgaagaaagtttagtgactcttagcttgatagttccatacaacagaattataatgattcatagaaagtattccattgtaaagaaacttatctagaatgataacttatgaattgaggactaggcttaatgttctggtgtgtgacacttggagctattggtcagttcttatttttaatcgtaaatgcattttaaagaaacagttgaactaaaaaggaggccattcatgatactgtttttaacatgataaaaatgttgtataaatcccttcgctcctctttaggtactacctgtcccacccacatcctcacccccttccttaactttcatacattataaatgccccccaacagtctctcaaccctgaattgaccaagtaatgcaccaaaaggcagattatgctttggcaagcaggaattggactattctttgagatttttctgaggtagtgagtctttcctcctctgctctgatgttaagaaatgtcttgaaagctgagttaagagacaagtggagtgttggtcacagtacttaacactactctgaaatgggtggtttatatgatcagacgattaccacaaacttcaaaagctcttcagtagaatcctgactgttatgtggagaacttaaagataccgaggttgctatgatgggataagccgcagtctctaaaaaagtgcctgtcatatagttaggtgctcaataatgtttatgactgactgaatgtttaagatctctgatttggctcagtgagattacaagcaaaaacaatattaaaaaaacctagccaactgcaggctaataacatcaaaggctagatcactttccctgtgtatggaattttggacaccttttaaaatatgggaggactgagtttaaacagtattggcatagtatggtattcaattccacactgactccatttatcaggcaccctcttatttccacctgattttactatcatgatgtggtagtgagatttctatccataaataacttttctgaggcaaagtgatccagtctctctgctgttcttcaagcttttctgccaagcatttaatcaagtagggtccaccttagaatcaaatttattagcaaaccaatgtccatctttgataagccacttaattctgcagctccataaatacacacgcttcgaaggtgagatccagtacaactgggaagaaaaagccttcatagtaattccacttgacaaggcgagtcttactctgcagatcagaccatcctgggctgatctggaaatctccccaggtattcctggaacccgaatcaaggtagccaaaagtgctcatcaggagagtatgtgtctttagaccaggcaaaaaagtcttgaacgatgagttgttgaaaatatatttaacaaatgcttgacttaaaacaaaataagcactgccaacaatatctgaatgttatgggggggtgcttccttggagatgtttgtccttattggtagcttccatattcataaggcacccgtctaagttcatgatggtaagtgaatctttccaatttactgttgggggtttcaccgtctccaacatatttgctccattgagttttttcaactctgacaccattcaaaatttgacttcaggggaaaatcttgcccacacaagttgataacatatttccacggattgaagacttcagaaggtccgacaagcaatttaaatcagcctggagtctggaaatggggcatattccacagcctctaatttggaagcaatgaaaatattggagaagcacttagctaattgttcatggcaactttgaaggtatcaggtgccttacgatcataatggatgcagtaatattgtgctggttgtatatagcatggataagcctttcaaccataattgcatctttgtggcaaccaaagaataggctattgggaagcttttctcctcctttgagacaagcttttgagcaaacctcttagagtctgataaatgtcacaatcactggtcattgccacaacatcatcatccccaagtcaatgatgtcccttcttcttatttccagactctttccaatttccaaaggctccgttcatagatacccgaacagttaacttcatacctgacttcatccttaacatgagtgtattgtttcttacaaaaggcgaggtacttagggagtactcaaccaagtaaatgtctttttgcgaaagagtcgtctcacatttagaagctttaacaaagagagcagccatagggttaaaaacggatgaaaactttctgctgtagggtatgtttaaaataacatttgaatatcttcattctgaagaggagaaagaaataatccagttggaatattaacagaaaatcaggtcagtttatccaaatctactgggcgcctaccacatactaggcaaatgctgccccaaagatgaatgaaacaagtttttacccttgaaagaatccagaaataaggaaatggaattatgaagaatggtggtatttggggtattctgtgttaactatacctaattttgagagatgttggtttccaaacagaaggaaggtaatgtaaactcctaaaatataaatatagtgtgtcttatattgtctgcatttctcttagcatatttgaggagggattgctctggtttgggcagaggtctagagaactggatgtatcaacagggcctcagagatgcaaaggactcacctaaggccaaagggaacattcgtcttattctacctccagatccctattagatccaggtctgaagtcaaacaaggaaagcccagggaccccacgttcagaaagaagggtggtgggcagacacccaaaggagctatgctaagtattgagactgtaaaatgtatagataacaaaattgggtaagcctgcatattttccttatttttattttgttaacacccattttcacacagggattagcaatttagcccttaaaataaaaaggcctgatttttcactgagagtagtaggtggggtgtaaaaactacgttggggggcaatttgcaatacttgtcagttttaaatgtacccaccctgaagatcccgtgtgtgtgcaaagtcaacacaaagaggttccctacagtgttttgtattcaggcaagacagaaaatctctcaaacatcttgaacagtgcattgattaaattacatccatgctataatatgtgaaaaggcctgagacactctgcatgtacatgccaatggggaacaatctctaagatatactgtgaaataaaaatagcaaaatgcagaagcatgtctagtatgcttacatgtctatacatacaaagaacatacatagcaaactttttctctctttttttttttttgagacaaggtcttgctgtgttacccaggcagagtgcagtggtacaatcatggctcaatgcagccttgaactcctgggctcaagcgatctcctgcctcagactcctgagtagctagaaccacaggtgtgtgccaccatgcccggctaatttttctttagtagggacggagtctcactgtgctgcccaggctggtcgtgaacacctggctcaagtgatcctcctacttcagcctcccaaagtgctgggattacaggcatgagccaccccctcagcctaaactttttcttaaaggaccagatagtaaatatttttggctctgtgggcatattgtctcagtcacaactactcaattccgcccgttatggtaggaaagcagccagagatatatttcaatgagtgggtgtggctgagttccaataatactttatttacaaaaacaggcgctggctggattcagcccacagctgtagtgtttccaaaaggatattgtatacacacaacctggtaacgggaattgctttgcagggtagagtgggaaaggactgaggaatggggcctagtaggaggaggatttacttatcactgaatatcttttagtatcatttgcatttaaaaatgatatattactttttcagatgaaaacaggctgactaggaggagggtacagatgtacttataggagcagcaagaagggcggcccaggaagtactagcccaaggctccaggacaggaaagctgcagagctcctagggctgcttcaggaggctcagatactgagacctggtggggtctgagccccctgtgcaatttcctaacatatctcaataaaccttaaatggaagacaatcattgtatcaatttcattcaagagaattgccaagaacttggaacccagtttaattttgtagatttcactatacagacccattgacaaaactctcccctgggaatgagatcccaccttcctcattcactccgcttaaatccctctgtttaaagaaccacaccttcaccaccatcaactgtactgcaaatcccacctctccagccacatctcgtctctcctctgtggactgccccaggctcctatctctgctcacttctcttctcctgcatacttgcccccatctccagattccaccttccacacgatgcctttccatattccaacacctttccctccagccttcacctcttgcccaagcctcaaggtggacctgcagttgctggatggacattgcttcctgatatcccacaggcactcagccccacgagtccaaaactgaactcgacatcatcacctcgcctgcgtcttctgtctcaactttggcaagaccatccactcatggcccatgtttgaaactagagttacccaacttgtccattcactcatacccatgtcaacctatcacctcataaatgtgcctcaaatccatcctttcttcccatccccgctgccaagtccagacagcatctttgctgcatcagcacccaggttaagagatcctggtcaggctcatagcccagggtctgttgactggtctcagctttttgctcctccaagcacactgaacagggtcccatcactcaggctcaaggccagggttcttgccagttgttctaagctgtggaaaactgtccccactcccttgcctgacacacaaggcaactcactgcaactcagaagcctgggcacatgtgtagaattgggtgttgtggtacagtagaagactaatcaatccaaataggggtgggtgtgtgtgtgtgtgtgtgtgtgtgtgtgtgtgtgtgtgtgtgtggtgattaattcatggttattaggtataaatagtatgtagcttacagaaatggctagaatggaaggggtctaactcaaagtaaattttggctatttcttttctcactgtattagtccatgagtctctaattaatgttagcacttccccctgacaccacagtggtaaaaagaaaagacccacattctaaagagatttaccaagtctcccagagttgtcatgtcatttaactatcatctcacacttaaataaaaaagacaaaggccagctccctgccttgtcactcatttccagggcccttctgcatccaggcatccttgcccttcctgagaaggcctggggcacacacatactgacctagcctgggatgggagagtctgagctgggcaggaggtcatggttgcctgcccagacatgaagctcacaggacatccagggaaggaagaggtgggaggcacccagtgagaagtcctttgaaactggctcaggggcccacatctgagagccaggaatgagagtgaatttcaaagaaagagggtaggaaaatgggacagcccaggcacctcgctttctgatataccttcgcccaaggctctttaagggggagagtttgtttgtcttggggtcagcctttgatatcctttgaaaggagagccctctccaatattaccctgtcccaaatcaaaataaaaccccttcacctgcttaccaggccagaaatccctttatttatttatttatttatttttttttttttactttaagttctggatacatgtgcagaacaagcaggtttcttacataggtatacacgtgccatggtggtttgtgcacctatcaacccgtcatctaggttttaagccccgaatgcattaggtatttgtcctatgctctccctccccttgctcctcaccccccgataggccccagtgtgtgatgttcccctcctgtgtccatgtgttctcactgttcaactcccacttatgagtgagaacatgaggtatttgctttctgttcctgtgttagtttgctgagaatgatggcttcccacttcatccatgttccgcaaaggacatgaactcattcttttttatggccgcacagaaatacctttaactgaaaagattcctttccccaaagaggtgcgtaggtgcaaagccacttggtatggagtttctgtcaatcctaaaaggggatgttggcctcttcccagctgcggtgggcactaatagtgaggggaatctggcaggaggttggagaggaccaccggtccccaaccttggttcagctggctttggcttctctgaaaagaacatctgcataacacccttgggaccctcccattgggctctgcagggggacacccccagagcagcacagccccaggggacacaagttgcagggggtggaggtgggctgtagaggccccgggcctggaggaatgggaaccagctccttaggtctgaccagagtcagctggctaaggctggctgtcatgttggccacatggttcctaagagaccaggctagcaatgtcccttctgcaagcactgcacccagcactttccctcttaaaggcttatgggcaggaagcagcaagtgttttgctgccaggaagtggtcttacaattacattacaaataatgccccacccagggagaagcggtatttccccttctacctgcccgggtagacaaggaggtctgacctgttgggagtttattgccacataggcacaagttcctagtgatgacagaactgaaaaagctgttgaaggtttggtggctataactcaggtgaaatatggtctataataattcagtaaaaacctatcctcactaaagtcccaatagggatgttgaatgaggcatttccctcaaaccatgttctttcccaacccatccaggcattgttggagccttcaaggaagcagcaagaacacagaggtgcccccagctaagcggacacgaccgcattcagggacaccccagctaagcggacacgaccgcttcagggacaccccagctaagcggacacgaccgcattcagggacaccccagctaagcggcacgaccgcattcagggacaccccagctaagcggacacgaccgcattcagggacaccccgctaagcggacacgaccgcattcagggacaccccagctaagcggacacgactgcattcaggacacctcagctaagtggacacgaccgcattcagggacaccccagctaggtaggcacgctgcattcagggctaaatggctacaaccattagcagctcttcaactaactcttcttacctggcaatttaaaaacccaggactttcaaagaagtacagatgcttcctttcccagggaagaaggggaatggtaagtcaagaatgagaggaagactgaggaaaaaaggacagagtaaggcgagtttagggaccaagaatgcctgagcttttttcaggaacaggttgtggggcactgggggagaggaagaaaggagctgcgcttcaggatgccacagaccttgggcctgagtccctggagaactcttagtagctctaagactttgatcaaactatttaagctctctgaaggccagtttcttgttaaaaatggggctggactactctaggaaaatgtggccagattgctttttaaagcgctctatgatcctgttcctcctcaccgggtgtgacctcccaaccggggtctccagctacccaacgctggcgctttctgactgacagaggtttcaaacctccctgggatgcagctcccaagggatgggcaggccgccatctttgctgttttgcaacttgactgttgatacctgcaggtctggaaaatctgagatgattagggacttcatggcttctttaaagatcctgcccagaccttggcttattgtcctgtttttcaatctacctcctatttctccacaaagtcttaacaaattagtattttagaattagtgcacgaaggcctccatgtaatgctctttattaattttatgtaattcatccctcagtatatgcagaggattcattccagggcccccgtccataacaaaatcttgcacactcaagtcccacagtcagtcctgaggaaccaggtatgggaaaagttggccctcatacatgtaggatttgcattctgcaaatactacattttcaacttgtatttacttgaaaaaaaaaaacctgtgtataattggaccccctgaagttcaaacctgtgttgttcaagggccaactgtagttattaataatgtagaatcactcaatcaagagttgtcactaggtgcactatttaagtactctagatgtaattcaatcccctcaagagatcgatgaggtaggtactactgtttccctctattataagaaaggaaactgaggcactgtaagacaactaaataaatgcccaagttacagttctagaaagtgctttaaatggaacctgaactcagagagtcttgctccagactgcacttttaaccctttatgcaatagtgtctctcagaatataaagaaaaaattctccatattcccgcaacagttttagcacttgactaaattttctcattactatgtcttctctaaatgcctagaacaggaacaggaatggatcccaaacatggtcgaggagatcttccaccctgtttagagatgatttccatggagaatgagcctggaggaatgctgggtgaggaatcacattctgctctgcagtcagaggctgagactgatcaatgagctaatgaagaggttagtcagtcttccgcccgtagaatcaattcaaggaaaagagagcaagctcatcctgagggactctgccattgttactcctgtcccgtatcctgtcaccaatgactatcgattcatttgttcttatagttattgtgacaccatttaag

SEQ ID NO: 5010 - DNA, 15057 bp, Homo sapiens
ctctcacctacagaacaaagcccagctttcaaggtatttgaacattcagcccctaaccccccttccaggcttctcctgcaccctacaaaccagccacatagaacccctttcttgtgccagtagaagtggtcatcattggtcatctctttgctttggtcatgaggtcccttcagtttaattgtctttcccattttctcccaaacatctatcaagcttgtccaacctccagcccagggccacatgcagccaaggacggcttggaatacagcccgacacaaattcataaactttcttaaacattatgagattttttcacattttttttttttagcttatcagccatcgttagtgttctatattttatgcatggcccaagacaattcttctcccagtgtggctcagggaagccaaaaattggagacccctgatctaaatactccatgtacatgaaggtcactttcactgctgtttctcccagaaatgtctaggtccttcaggtagaagtaatctttttcttcttgtaattattttatgttctttttaatcctagcttctgaggcctataaggttaaactgttctcatcttcatgaattgttcagtagagtaaaaacagtatgcaatttcacttagtttgtcaaaatccagaaaatacttttgaattgttaaaaaaaaaaaaaagatccacaggctgggcacagtggctcacgctgtaatcccagcactttgggaggccgaggccggtggatcacctgaggttgggagtttggaccagactggagaaaccccgtctctactaaaaatacagaattatccgggcatggtggccacgcctgtaatcacagctgcttgggaagctgaggcaggagaatcacttgaacctgggagcggaggttgtggtgagccgagatcatgccattgccctccagactgggcaacaagagcaaacttgatctcaaaaaaaaaaaatccatagaattaataaacaaaacctggctgggcaggtggctcagacttgtaatcccagtaccttgggaggctgaggtgggaggatcacttgaaccagcagtttgagaccagcctgggcaacatagcaagaccccatctctatttaaaagaaaaatttaaaaaaataataaacaagacctaaaggttttacagtttaactctttttttttttttttttttttggagacagggtctcactctgtcacccatcaaaggtgcaatcctcccaacacgcctcccgagtagctgggaccataggtacatgccacgacacccaacctttttttttttttttttttttgagacagtttcacgcttgttgcccaggctggagtgcagtggcatgatcttgctcactgcaacctccgcctcccaggttcaagcaattctcttgcctcagccttccgagtgctgggattacaggcatgcaccaccatgcctggctaattttgtatttttagtacagacgggtttctccatgttggtcaggctggtcttgaactttcgacctcaggtgatctgcccacccggcctcccaaagtgctgggattacaggcatgagccactgcgcccagcatttttttaattttagtagagacaaggtctggttatgttgcccaggctggtcttgaactcctgagtgcaatgatcctcccacctagacctcccaaagtgctggaagtacaggcgtgagtcacctcacctactccataatattttaaaagaatggtgagaattaaacactatacacacaaagtatattagaaagtataggcctggcgtggtggctcacgcctgtaatcccagcaatttgggaggctgagtgggtggatcacctgaggtcaggagttcaagaccagcctggctaacatgaccaaacccgtctccactaaaaatacaaaaattagctgggcctggtggtgggcgcctgtagtctcagcacttgggaggctgagacaggagaattacttgaactcaggaggcagaagttgaaatgagcgagatcacaccattgcactccagcctgggcaacagggtgagactctgtctcaaaaaaaaaaaaaaaaaaaaaagtatatttggggccaggcagctcacacgtgtaatcccagcagtttggaggccaaggtgggcagatcaattgagcccaggagtccaagaccagcctgggcaacctacaaaaacccatctccacaaaaaaaatacaaaaattagctgggcatggtggcacatgccgtggtctcagctactcaggagactgaggcacgaggatcacttgagccacggaggtggagttgcagtgagctgagatcatgccactgctctccagcctgcactgcactccagcctgggcacagagggagaccctgtctcaaataaataaataaataagcatatttgtcaataaacattaaaaatatttgataagacaagtataaatgtatattagcaaaatcatgaatgatcttggacctggagagatttcatttctaattttacatcagtacaacagctttcattttcttaaatcctgatcaagcagaaatgcttgaaaagaaagagcacagcaggccgggcgtggtggctcatcctgtaatcccagcactttggaaggccaaggtgggtggatcaccttaggtcaggagttcagaccatcctggccaacatggtgaaacctgtctccaataaaaatacaaaaattaggtggcgtggtggcacaagcctgtaatcccagctactggggaggctaaggcacaagaattgcttaacatgggagacggaggttgcagtgagccaagatcatgccactgcaactgcactctagctgggcaataagagggagactccgtctcaaaaataaataaataaataaatagcaggcagggcagtggctcacgcttgtaatcccagcacttcgggaggcgaggtgggaggatcacctgagttgggagttcgagaccagccttaccaacatggagaaacctcatctctactaaaaatacaaattagctgggtgtggtggcaggcacctgtaatcccagctactcgggaggctgaggcagagaattgcttgaaccagggaggcggaggttccggtgagcgtgagatcacgccattgcatccagcctgggcaacaagagcaaaactctgtctcaaaaataaataaataaataaaataaaataaataaatagcacagcaccttgctttgaccccagttgtttgtgaaatacagacaatttaccacccgggcacttccagggctccctgtctgcatgtccttcactttctactttacataggattatccgtggcaaatacgcccagaacctcctggagagcagagtctacatcagatatctttgtgacccttaagggcacccagggccaccccagagattctgatttaatcggccagctaagcatgggattgaatcaggtttcagtatattttagaaacctccaacagtgtggacgagaactgctgagtcctaactcattcttggtgctaaaaagtatttattgaatcaatggaaaattaacacagtgccatctcttgatagtcacaacaagaaaagcagctgggaaatagtaccacattttacagttggaaaaacaaactcagaaagcaaagaccattctcatcatcacctggtggagccagtagccctaggaaatattccaccccaccagagagagctactgtctacacagagcagtgttcctcagcttctgccagggtgggggcttgagactaagaatggaggtatagcagaggtgagggtttcagcgtgggtttcaagtctgtctccctggttctgtgggtaatttcaggagggtggagggaagggagggtgcagggattggttggggttgccctgtccatcggctgtgtcgctgacataaaatccagatagaaaagctaagaactctaccggtattctacccggaataccccgcctccgctgccaggagggagagctcccagatatccaggtcagactctctcattcttgaattatctgcacagtccctcccacgtcccagcctagaaaagcttctgactctgggcctcaaactgcaatgcacctttcagtgcaataggagctatccaatctccagccggtccatccgcccactcgagcccacctgtttgcggaccacagagcggcagcacatccctaacggggctgtcaggcaaggtcaacgcgctagagtgcaagagcctttgctttgcggattgcgcagcgccgggtgtgggcgcaggtggggatagagtgctgggttttgaaagagtgaccccaaagctgagggtgcagagcaagacacagatctgggaagagcagagaaaaaacgctcctcttctgaacccctcccacctcgcatcacctgacaagtctctcaaggtctggtgtcgggaaccccacctcttcaaagccccgcccttcgaaacaccagaaagtaacccccctgcccggcctgctttccccctaccccctgccaagctgcagttttttttttgttttttttttttaactggtgagggctagaaggagcggtagagattgattcattctagccaaaccacctctcttaaaaaaaaaggaaactgaaccccgattggcgaaatgtcttgctcaagtccataaagcgagacaccggctgatctggacccttagaatctacccacccttctccacctcccctccccagctcctgttgccatggtgatgagaacaggctcctgctgaggctctggctgtggtcgcaagagctggagaggctgaggactgggctggatatgctgaccatcagccaagccccatccagggccgcgggcagttctgcgcgggggtcaggccgctggcccatttcgcagaggcggggagaggacgaagcggctcatctcgcagtgtggtgcgggggcgccccggggataccgcctgaaggcgcctggagggcgcccgcggggtctgagtgtagagaaggaagttgcagctgtagagtcacgccgggaaaggggctggaagggcagcgttcggggaacttcaaatgcacagactaccccgagtgagactcactttacaaaggggaagctgaggcctgaggtcactgccggatctaaagagagggggtttcggtggaggcgacagaggtaggggggcggcgagtccctagagactcacctgtacactgagatagagctcagggtcgaggtccggccggggcggcggttcccccggtcctggcgcaacagcagtgcaccgggtctcttggccaggccctttccgctcgcatcctccacaaccaacactcgatcaccgcgggtcctgctgagacggcggtcgccaggcctggcgtataggacgcgagtgaggagcggtttgtatgtctggtgacctgccccactcccaccctggcatggctccagtggggccacctccctccgcttccctctagttcttgggcgatgagtcgcgggttcgctcacccaaagccacagcgaggagcagagacagggacttcatggcgctgcgacctctcagccatgaagcctcctcttcctcctttcactttcactttcctccaaagggcggcataggggcggtggaaatccccgctctggttaggtgaaggtgcctgggggaccggtgtttcccactggccaggcagggacccgggtagatcctctccagttctcaccaggacaccccagcctaccgcgccctcctggactacccagcagccccgagttcgagccctccccaaccccaggcctcccccgccccccaactcctgtgtgtgctctccaacatccacttgcccgaaaaccattctccggcttccccctatctgtgccgcgtccccagcaaacacacgggttatcgggaagccagtaaatgaccaataaatattttaatcactgttaaaaaaaataaaaaccttgtactcctcgacttactccctccttgtctccacccactcctccatgagaaccgagttgggaatttcccgggaagtcgggggtggcggggagagacagggtagaaataaagagcgcatccttgagaggggtaggttctaggacaagggtggggctcaaaggccttgtctccacgacaacacaaacaagacttcaggcacagactacaaccacctgacccctgaccctgtgactgcaggatgttcacacgccccctctccctccctccatgtgcaatctactctgtggagcaggggcttcagtgtcccatcagagggaaaggaagggtttagttctggaaataccttgggggggaggggttgagagtagaatgggcgggcgatggtgaaactgtggttccccttccagaatatatacaagtcccagagataaaggaagacagtaagtgtggtgggagatcacccgggggccacagcgcccttcatcgtgctccttattccctttcccgaaagctaccccaccccagtagcctgccccttcatttgctcctccacctccaccgaagcccatctccaccttgtggactctgggtggggaccaacacgtctgctggacgggggcgtggccgcactcgcttcgtcgccgctgcccccgcccacccgggagactctctcttggacggcaaggatggccccgtgggagtcccaggcccaggtacgccccgaccccgcccaggcggtgccggcgctcacagtgtcctcggtggcgcatgaagcttctcgccacatgaacttcttggcgcagactccgcactcgtagggcttgagacctgtgtggtcttcatgtgctcagtcagatggtgcttcatcttgaactttttgttgcacacggggcatcaaacggccgcagattgaggtgcatgttcacgtgccggtcccgcatgctcttgtgggaaaggccttcccacaatggcacagaaagatcttattcccgtccccactgccagtccctccgggaccccaccaacgctacccggcacacccaggctccccaccgacgtgccccccacggtactgccccgtgttctgcttggttccctggtggttggccaggagcctgtgaggatgaggagaagacgacgacgggaagaccaggatctggttgccctgcatgtccaagggaaggagcggcgaggagggtgggagggggcataggaagagggagttggcccccctgagtcatcaagaccgccacaggacccccaccctcatatgggccaaagtcattggaggactcacagaagttgactgctcctcccccttgtctgggggctcactcagggtacggacatcacttatgctgagggtgcctcaggccctccccccactggaaccctggagctaccccctagttcttcatcttcatctcctcacaggtcaacaccagatcttcctcctcctcttcctcctccagatctgggtcttgggaaccaggggtgttggcgctgggcaattaccacctcgcttcacgtatacccagtgttttgtggcatgatgctagggggtgtgtaggtgggtctccggagcccagccccaggaaccacgcccccctcccatccccaccatcatcgcacagctcatctgcctccagcagcagctttccgatgtggcccctccactgccaacgacaggggctgggaatacagggccacctcctcgacgtccccactgcccactgcagaagctgcaaatgcctcttgggaggaagatgagaaatcagtgactccctggggctgaagtagttgctgctgctgggagattgattctcactggcccggctgaggcatgggagcgcgcagagcccatggtagcaggggccacagtgcccccactcccggaggcaccccagcaccagggacagtgacagaggtggctgcagcagtagtgatggtggtggtgctgaggcccggccttctcggagtagttcagtgcacttgtccacaatgtgccacatttgagcacagaccccactgtaaggaagttgacaatgtcagcagcagccatgctgaggcggccgtgtaagcggaggctaggacagtctcaaaggcgcctgggtccatgacactgggcagcgaatggaggtcatgcctttgagtaggacctgatcatggaagtaaggggaggaggcagccagacagcccgatgagcccggaactcccggccctgcactctgatagatacatcgcagagctgccctgcagacgctgctgattgagggactccaagagggcactggtcacctcagggaaggaacatgtaccactgcagctgctggcaggggtagtgggggcggagccagcgacagcggcagggaagtgctgccccactgggagacagaggagatggctccatgttgtggagggaggggatcccccccagccacaggaacaaagaaaggaggagggcggccgggggggtctctgggaagaaaagagaaaagaataatgataacatctcataacgacacagcccgttacaactcaaaaattgttcacgctcattatctgtgtaactccccacaacagtgaggtaggtattcctctcaacccatttgacagatgaggaaactaaagctcagaaagattaagagattatccaaggtcacaagcaagtggcagcgccagcaaacacaggtatctgacaaatcttgtgccctttccttggagttagagaaataaggtgctcttaggggctggagtggcttccttcggaattataccctattccgacttacctgagagcctgacattccaaaatctacctttttggtgttttgcacccacttttgggagggggcagggcagctctgctactgaaaaccaacgcttgctccatctcccctaggctatgccccccaagctctctcgccgaccacgccccctttcgccccagcttctctagcccgcccctttccaggcccaccccccccgtgccccgcccactatcgggcctttcgacccgccccttgtctacctccgcccacaacggaccccgcccccccccgctccgccccaagcgcacctcggcctcttctcccacccggaaggcgccccccaacctcgcgcgtccccgcttaccggccgcgcgcccccgggccccccccgcccctcactcggcggccagagcagcaacctgggccctcccgccgccatcttgcgccgactccctccgccctccgcctccgctccgcctcccgccctccgcctttaaaggcacagccgggcaccccgcccgtgccgctgggcaatactcggcgactcggccactttgcctttaaagaaacatcgccacattccaccttaaaagatcaggtccctcctccgctgggagctcaggacttggttcggccgaagcatttattcccctttaaagcataagcctgccttttcccattggcgatgggtccaggtatcgttccccaggctccgcctcgagctgtgaccattagctggttggtgggatctaatcgccctcttcctagctccttacagcccactgaagccccgccccctttctccgggcctggattggctaaataaccttgagtcggccctcattggctttctcactcctactgcacgaagtgaaaaagtaaagtgcgttaaggcgctgaagcacttaaaaaaaaaaaaaagtactgcctgaacaacgtggcgaaaccccgtctcacaaaaaatacaaacaacaaaaacaaaaattagccaggcatggtggcacgcgcctgtagcccggctactcgggaggctgaggcattatcgcttgagactgggaggtccaggctgcagtagctgtgatctcaccactgcaccctggcctgggcgacacagcgagacaaaaaaaaaaaaaaaaaaaaaaggccaggctagaaaggacagagcgggactaccccggggatactgggctaccctgagcaaggggacagctaatgccaatctgtaacagtagaaggacaagaaaaagacatgatacagtaagaaaagaactttattgtttattaatgtttctgtgtaaaacttaagctttttttttttttaaagaaacaccaccaaaaggggattagcttagtccatcccttcctcagcatctgcttcccaccttcctccaaatgttatcccagaacattctggaggcagggagaagggaggcagctaatcagagtctgagagcacgatgatctcttctggatcgcattgtgtggcacacttgtctgcagggaagtgagagacaaagagtcaaagagatctggagtacaggagaaagaaacaggaggatttagaggataaaatgggtgggaaaaaggaagagacaggatgtggccgtggaatattcagacagagcagctgaaacagccaatgaaagagaacaaattgtcagagaaacacgccctccccttcttaccttgcaagtaccaggccgaggaggctgtgaatgggggtttgggacagccgggctggagaagggatgcagagggagctggtcaccaggccatggctggagagtccaccctcgtggaggaatcagcaactggggccaaggaagccaagggggaaggtggctgggcagggtacatatctttttcccattcttctcatgcactgacctttgcctttcccatagctagaaacagaaacataaatatgtggaggggtacgggaagactgaggctggagggggcagtccagtctctcccagcagactcagttccccagtattgctctccgaaagtccccgcaatccctccttggcttccctcttcctcctcctcttgttattacctgtttcctaatggcctgatcctgtttgcttcttctccttccgagattttttgcaggggggaccagaatctcccagttgtgaggagagacgcctccattgaaggaagtagaagagaccatgcctgctccatttctaagacagtggtgaagggctcctctgattgcttcctggaagaggaaatgtccgtctcacagaggaaggggtatccaggggcaaagcttcaatctctagctcaaagagctgagacacgggctttcttcctccagggtcagctcctcaggctgttctccattgctttcagcatctatctggagggggccaggggttcttctgacagtaacgatggtgacactatgcgtcctttgtttgctgctcccctgaagatctgctgatctgtttgccaggttccaggttcttttcattggaatctgtagtgaggacatggggctcttgtctccatctttacctggaaaagaagaaaagggagagggtagcctgagaatgagggggaaaaaatactgctgagaggacactaggaggaggagggaaaggtttcaaacaggtggctcatgcctaacaaaacagaaatgacaggtgaggagatgttcccttgacatacctgctgctgcttcttcctcttcgtcctcctcttcatcatcctctgaccctcctgcatctgttccagatcctcctcctcttcagaatctgtggcctcctcctctcttcttcctcctcctcctcctcttcctcatcactctcctcatcgtcttcgtcatctgttcagctctggaggcagaagggcacccctgggatgccattccactagggccctgggagacaagaagtttctctaaggaatcccttgccccagagggtttggttcttgctttccttctcagctcccccatcagtcaacctggactccctggtggccagtgcaggggaaggacaatgtcttctgaaggctgtaccccatccacacctcaccagaatccaaggaggcttcgggggtgtctcagagtgggaagaggtgccttggagccgagctcttctcttttttctctcgccctcctcattttgtcttgcaacattgcatatttggagatgacctcatccagccgactcatggccaaatccggttttcccgaaggcgccgggccaacacaggatctgatagtgcagggtcaacgcctcgtgggaagacataaagtcagagcactcagcccttgaagggactagaagagtaaaaacctagaaaggactagagagatgccccatccgcctcatacctgacatataagggtcactgagggcatcccaccaaccccctacctggcctatagtcatctgtgaggtggcagccaaagttgagatgagatcgaggtgacgtcgctcctgtaacctgatgcccacatctcggaaggcatccgagccatgagctggagctgctgtcgggggaggccaaggctgtgtcgggcagctgccttcctacagcccgaagcacatccccatagtcagggaaggtatcaggccctggcttgttgatggccgctcaatgcgcctgttaacctctgggtagcgggtgccacggtaggggatgcgctgcctatgacacggccggtcagtgaagagcagtctttcagctcacatagtcgcccaaagaggggatcagcttacgcttcaaccgtgcctcctgcaggtatgcggagtctgggtcatccaatctgagagatccaactccttttcctgcagccgccggatctctgccacatagagcgccagcgctgctccaaacgctggatctgccgccgggaaccacgggtccttggagactgagaggcatgttttcagcatttgtggggtccaaggagaggtgtgtgggagggttattcccagagggccattggaggtggtggcggcaggggccaagttcagcttctttttggctgagtgggccttggaacagtgcagagctcattgatgtagacatagagcttggctggccggctccgggcccgaacaggaccctagagaggatgttgcagaactccgccgaggccaaaaacagagagtgggcagttgctgccggttatagaggaatgggaccacctcagggtggtctgctgtctgcatcttaaaagttcaaggaactagaaggttcaggggaagaaggaaggggaagagagacaagggaggggttgagagaaaggggaggtggggttagtgggaaagaaaggacaggagaaccagtcagcatccccctccctggggtacaacaatcttccccgctaaagctcacctcttcgaacagctttcattctccagcttgtagcatttcttgccgcccgaactactgcttcctctggccccatgggctcagaggagctaggggcttctgccccaggtgaggccgcattggggagtgggtgggaggccctggctgagcagctgcttcatcttcgtcatcatcatccagcacgatgatgctgttgcggtggccataggggatcaaatcccccggagggaggaagtggtggggatttcagaattctgctggaaggggatggggcctcagaatgagcccctccagcatagccccatcccttcactcacacattttctgaactccttgggtttcagtaacatccagccctgaccaacactgtctcaccacctgatttcaataaccattagttctatatgctttttggggcccttcaagtggtgggggggggggcaaaccacccccacaccttaagttgccaccttctgctccacccctcacgcgatttccggtctttctgttgcatttcccccctatttcttagagttggcaagttgattctcctcccacactgcaccccaaatcgtcctgacacccccttgcacagacaacacactccttgggcgccacctcatgtgtttgccccctctgctctcaaacaagtcaaccccacacccacctatcctgaatgatcaccccaactcctagactctctgaggtgaaagaggttccctcccacagtccgttctcttttctcctccttgaattatctccatatttcaccctccgatgagtctctcaaactggggctttaggttgaagatattttacccaagtcccctccctttcaccccacctaattttccccattctctcggtgacccgtaactgatcaaaagtccccccgcaccgcgcacgctctcgcgattcctcttagatcccaaccgtgggtccggccggtccgctagatgcgctcccgccaaatccccctcccccagttcagcccccggccgctccactccctttcagggacggaaggtaccacagctttcccctcagactcagcgcccagctctccccaatacctctcccctatatccccgcccccgcctctgatccccgcaccgtccggcccccacctcagaaaccgttctcgaggcgaccctcgccgcaattctcagaacctcgcatggttccctccgccttccttccactcccaccgcaggccccactacggaccggaagtcacagagtttccgccttcatgcactaagcgccgccatattgtcgtacggaacacaggcttcctgtggccggaggtgacagtagcccgccccgcgaacacctccagtgcggcccacatagtcagcggtctcttccaggtcgggtttgtctccccgaacccaggcgtcccaaagcagctgggggccgccattttgccgtacgcactggctacgcccggactccggtgcgcagccagtggagctcttttcacccggtgcttcacgactccgccaatcagaaacttcctgcctggggcccaaccgccggagagtagcgcgtaggaggaccgagcctcgtttccaaggaggggcaggggaaccgaacagggtggattaggaatgggctttccaaagctgtgcagagtttcagggaagggcagaagtctcttaaaagggaagaaaaccttttctttcagttgggctattggcaagctatctggccctgctttcctgtccccaggttcccatttccacggcttattcggctgacccagccccttcccctgcaagggcggcggctccttgccgctgtccagcagctgtttctactgccaggtgctgcgtcccgcgatcgtttaacacatgcgtacaaatgagcacaacgcgccataaaagtgttattgttattactattgtgctgatttgcttttcaagcttcaccacagaactaatgaccagccagaccgttgggaccgaatggttcttc

SEQ ID NO: 5011 - DNA, 13299 bp, Homo sapiens
ctgttcactactggacacctttcctcttctgcttcttggtggagagggcctatttgagccctccagtaaggcaggcactgtactagttacttcacttgtgttgttctgcaggtaggcaagctgaggaaatgaggctcagaattctaaggacttgcccaagagcaaacagcacttgggtgtttgtaccttaacccaaattcatcaaactccaatgcaccaggcctccttaaccgcccaagagttctttcctcccttcactccacatttactggagtatatagtaggtcccgcccaggcagcctgccagtgatagatgattaaaaacccaggccaccagcagtgcccagtctagacagaaaatggaatgggtgccgatgggtttgcaggaagaagtctacttggagaactcatttaggcaggcagtcagaaggtgctctagagaggaggtgatgcttaagttgaatcctggaagggtgtaggtatttgtcaagtagttaagaggaggggaagacatcccaggcagagagcacacttgagcaaaggctcaaatggaggcacggtgaagaacttcccacagtcaaagtgtttggaaaacagatgaagctagagaagtcacagagccaaatagaaagggcatcaaatggcaggataggtttagactaaactgaggagagccagggaagctatgaagactttaagcaggggaatatcagatttgccctctagaaaaatgttagaaagggccgggcgtggtggctcatgcctgtatcccaccagcactttgggaggctgaggcaggtggatcatgaggtcaggagttcaagacagcctggccaagatggtgaaaccccatctctactaaaaatacaaaaattagctgggcatgtggcgggtgcctgtaatcccagctacttggggggctgaggcagagaattgcttcaaccgggaggcaaaggttgcagtgagctgagatcgcatcactgcactccagcctgggagacaggtgagactccatctcaaaaaaaaagaaaagaaaaataaaaatgttagaaagatctgcatgggctgtaatgtagagaatggatgggaggggcaagactagaaactgagacccgaaacgagccattggagaacttctgataagacttgaaggtggcctgacctagggctgtgagagtgtgaaacaaggaagagcctagttctagagaaacttagaaagtagaatagaatccaatctgtttttccccaaccatccctcactttaatccaagctcttactctgacatttcagggcttcctcatgggctcctgtgatgtgggatgtgaggcagagggaaggatgaatcgcttacttgtaccgggcaaagaaagatggcctgtcatccagaaaggacaaattcacgagagtgccagaggacctgcaacttaagctgccccctcccactccaaaaatcaaaaaggcagtttagggctttgtggtgaagagtcaacagaaaaaggggaagagcggcaactgggcctgaggaagttttctggagaattaagatgagcagaggtgcctgaggaattgattaggcaacatgcatgggggaaaagagttaagaaatactgccatggagcatgtaagaatgctaatgaggaatgtgtggggattttgtttgccaaatttttgtttgtttgtttgtttctgagacagagtttcgctctttcgccagtctggagtgcagtggcgcgatctcagctcactgcaacctccgccttccagtttcagcgattctcctgcctcagcctccccagtagctgggattacaggcacctgctaccacgccggctaatttttgtatttttggtagagacggggtttcaccatgttggccaggctgacattaactcctgatctcgtgatccgcccgccttggcctcccaaagtgctgggattacaggtgtagccacgatgcccagcccgctgaattgtttcttggaacatggcagcattcaactatatttttgggtaacaactttctaagggttataattatgaacatcatgacccagaaatgccctgggtgggatcatgaaatcacagaagctgaggattggacccttcagttccttctagaacatccatccagtagtctgacatggacagctcaccctattttggccagccatgagtgataaactttcgtcacactggattggcatgtgtacctctctgaagccattaaatggtcttgggtctctcttgaagttctacggggcaagcaaattcttccacgacaactcttaggctatttaaagcagtattcatggactgccagagcctactttttatccattccttacagaaaggcagtacaagcagatggaagactgaggaactggattccgaagacctgggttcaaacatagacttatttttataatctgtatgactttgggtaaactacttgaaatgttgtttgaatgtgattaccatttgctatgtcccctcgtcaacttgacccctacccacagcctccaggtctctgccttgactgctaagtggatgatggtgacacacacacatacatacacacacacacacacacacacatcacatttggggtctgctgacttagagatgcccaaaggtcactaggctgtgggacactggctggagcacatggaaagggaagcatccggatccacatttgcatgctcagtagcacatcgcccctgaagacagctcctctcccttccacctcggggaaatggacacagtcttgggaccgggtgtccacactgggatctgagctgtgagaaagcagctcaaagtgcctgtttggcaagatcttctttgttgggagctcctgactcaggggttctccagcatattcaagagttggaaagctgtggtgggctccagtaatttttaagaaaaactccaggtgattcatgagaagaaatgcatgctggattttctttttttccctcccattgctgctaaaattccagaggcctggctcactctcctccaaaggtcaagggtgggcagtgtcccaaaactgaagccaggagccaggatgacctcaggcagaagtgtgttctttaatctcacctttccatgttctctccctccactataaagaggatcccagggttgcatttgaaaaggggtcatcccatggtttttttggtcttgagcagagggctaaaagtaggtgtgatcccattagaaaatgtggcccaatatattttgagcatatagggtgcctctcccaagagggacctcactagggaccccagagggcccacacagacctagctggtgacaattatggggggtgtgtgtgctaggcagtggaggtttggggcacggtgccacagtctctgcattcttccatcattaccactaaccgtgtgatgacccatagagggaggaagaggcacagagggtaacaggaagcttaggggaaacagggtttttattaggagcaccaacatgtgaaactcagcggtgaagtaaaaggagggcaagtgtttcattggcttttgctcgagaatgtgaggggaatccctatgctcaaggaccttacagactagatagagtgactgcctacactaaagcatcacctcttccacacacaaatgcagaaagtgtgatgacagatgacagtgggcaagcctgggcagcccacgaagagcaaatgagtcagagcatgtcaggcttggagttattagcaaagagggaggcactgaacaggtgaaagggtcctccaaaggtgtccacatctaatccctgggacctgtgactatattaactttcatgccaaaagggattctgtggatgtgataaatgaaggaatctgagatggggagagtatcctgtatggcctgggtggggccagtgtatcacaagggtccttatatgggggatacaggagggtcaagggcagagaagcagatgtgacatgacagctctagtctgagagtcttccaagatggaggaagggactatgagccaaggaaccaggtggcctctaggagctggaggcaagaggaagtattgtctcctacacctccagaaggatacagccctgaaagaaccttaattgtagcccactaagaagaattacgaacttctgaccccaaaatagtaagataataactgtgaattgctttaagccactaaatccatggtaatttgtacagcagaaacaggaagctaatacaggctcttctaggagtccaggttagtgaaaaggcccaagcagctatagatttcgcaacattcaagtagggtttgggaagaaaaaaatggagggtttaaattacatatgcctttggttaccatatacagcacttttgaaataaagtgaaacaactgagttgcccacgcaaatccctgaacggcagaggcaattaaactgtttttcaggcagcaggcatcaaaagtactttcctatttttcctttaaaattccatgccatcatctcacccacaaccaatgaagcaagaaactgagattttgtccttgggatgacaccttgctgcccccatcgatagtcacaaacctcatgagactggacttggtccttttcttctctcatacccaacaagaactgagagcaactcccgtagcctctctaaaggacaaagcccattattgtggtgactgctcttttatgaagggctgggatcaggttcagggtgtggcataacataaggttggattctgcctgagtgtggcaggcatccacaccaatgtgtccagcttcagaaatggcatgcaagatgtggccaaacagcctaagagttgcacgctaggtcccatcaagctgtgtcccagcacatccggggaggaagccacagtcaggagagcttggctactcctggttggatatccttgggtgagtatgcacctaaaagcctcagtgttgtcagtgggattttgtagagtctaatttcactgtcagccaatgaccctgatgaaggcacagtaagtgtacacatgtatatccaaaaataattcccttaaggttgttctaagggtcacccttagtgcccttagtcaccatagcagcaaaggattccactaacatctaaatcagatggtgtcagtgctctgtgccaaatcctctagtgctttctaccttacccacgatccttgcattggcctatgaggcctaccatgagctgcttgccttccccaccccatctcatctacttttccttactccttctatgccagccacacttttcttcctgccctcctctaactcaagaggtcggcaaactttttaagggtcagtcagtatttactttcttcagctttttgggcaatgcagtcttcaatgccgtgactcagctctactgttgtactgcaagccagtcacggacaatacgtacatgaatgagcacggctgtattcctatccaacaagctgggaccggattggactgcagcctgctgacccctgatctaactcttcagtcacacatctgctccagtcctctgcacctgctgctcccctgacatacacatggctctctccctcacctcctcaggtcttcattcaaatgtcaccctctcaggaagccctgcccaggccacactagcactgcaccctgcttttgctcttaacgctcattttggttattgtctgtcacccccaccccccacgactagaataagggattttgtctgtttttttcaccagcgaattcccagctgccttgtattagcagacattcaagaaatattaattaattgaataaatcagtcttgttacgaaatttagaaaaggggagccatttcaaaaacaatatcccaaatgtaccctaacacaggataagggttgcaatatctagaaagcccaggtcaccagattacatcataattagtgatgtcactgttggaaaattctcagggtatcctctgatgtaggcctttcaggccttgaatccagtgggattgaaactttctaagagtggtgcggctcttgacaacatgtgggctccaccagcagcaatcatggggatgggcccaccaagaaggtgggcaaccaggcccccctgcagacacaggccctccagctgcctctttaagggatggcccggcgaagcgggccgtgtgggtccgccatacgagttcaagccacaagaacctactgaatcaaaggcagccaaggagaggcccaagcaggaggtgaccaagcagtggtcgtggacctgggcactggctactgtaaatgtggctttgccggcctgccagacccacccacaagatctcaacaacggtgggcaagccctacatggagaccgccaagactgggataatcgcaaggagacattcgtggggcaggaactcaacaacacaaacgttcatctcagctggttaaccctctgcgacatggcatcatcgtggactgggatacagtgcaggatatcgggaatatctcttccgacaagagatgaagatcgccccggaggagcatgcggtcttggttcagacccgccactgagcccacacaccaacagagagaaatatgctgaaatgctgtttgaaccttcaacacccctgcaatgcacatcgcctaccagtcgcgcctgtccatgtactcctatgaaggacctccggcctggtggtggaggtgggccatggcgtgtcctacgtggtccccatcacgagggttatcctttgcccagcatcaccggaaggctggactacgcgggctctgacctgcagcctacctgctgggcctgctgaacagtgcggggaacgaattcacccaggaccagatggcatcgtggaggacatcaagaagaaatgctgctttgtggccctggatcccattgaggagagaaagtccctctcagtgagcatacgatccgctacgtgctgccggatgggaaggagattagctgtgccaggaacggttcctctgctcggagatgttcttcaagccatctctcatcaagccatgcagctgggcctccacacccaaaccgtgtcctgccttaacaagtgtgacatcgcctcaaacgggacctcatggggaacatcctgctctgcgggggcagcacgatgctcagtggctccctaaccgtctgcagaaggagctaagcagcatgtgtcccaatgacaccccgcaggtaacgtgctgcctgaaagagacagtgccgtgtggaccggtggctccatcctggcctcacttagggtttccaaccattgtgggtccaccgctttgagtacgaggaacacgggcctttcttctctacagaaggtgcttctgaacggcgacgaggatggacactgcactggcagtgcctacctcgacagggtgagcgcactcctacacacagggggtggagccggcgcttattcctgtagcttaaacacccctcatatgcccctccacagtgtgtttctctacttcctgacttcataagaacaacttcacacgtgcagcatctgccttaaaatatacatttcccaaaacaaaagcaggatagggggaggatgaacaaaaaagggcatgcattgtatgtggattgcttaaacattcactgttctaaaattatgctgccccttattttgtgcattccccgctttaggaactactttacgttaaactctgcttggaagggggagtgcaatgaagattagagggtaaatgctgttggggctataagcagttccctttccataaatgccaataggaagtatgctgtaacagtgcaaactccacaaagcatcagtgtccatttcatacttcatcaacaaccctgagggactggaaagagcggcaaagctgtctgagccctgctttaacaggagtttcttttagttccaacagtcatttagtctcagtaccagttcttactaagccatcacagcgactggctgctgaagcctagcatatacaagcaaggcatttgtatgtgccttaaagggcaactcttcagagaacaagtgctatacgatttcccattttaaaaactgaagtaagactgatcttgggttatcagcagagaggttaggattgaggccacagtcattctctagacacttcaagtagtagctgaccatctcccagcagctggattctccatcagcctagaacacacacggttggagtctggggtgtgctgaggatagggctgctggttctggggctgatgatatgggtctgtgggaggctgccctatgtgggtcatctaaccccactggggagcccaaagatacacagagaccctcagtagccagggaagcccttcagggcccagcgagctctctggtgttcctgcagggggagtttgtaatatgagcactttaattggagattctttagaacagcctccaatacattctctgtcttgtctttaaagttcaaatctgaacactagttggtgcacaaaacagaggatagaacatgggctctggactctgtggttgaaacgcaattttgctaccacctaactgtgacttgagtttgtttgcttgcctgcaaaatgagtataaatgcctacctcacacagctgattaaaaaacagcgaaaaatatctgaatacagtatctagactcctgggggtcctcacaatagctagctagtatctttaggtttctacctttatgcagaaggccagaagtctcttactatagtccttagccacacaggtactcaaaggcggcattctgcatttagaggagagctggcacctccaccatctccagggagaagccctccaagctgctcactggttccaggcttgcctcgacagccttgaaagacctaaagtgcctgacctggatccaggtctggtgactaagagtatctggctggcaccagcagaaagagagccacagggggcatgtgaggttcccatggttcagcacggatgactaagccttatgctggactgtcaggaatcaggagttggggacactgacctgagagagagggacatctttacctcagtttctgccaaaccgctctactgtcaacccatgatcattcactgatgcgcaagttgaagtttggttgttcttaacctttggacctctttggcaggggtggtaaacccataaacctcttcttagaaaatgttattaaatgcataaaataaaatgtatgattacagagaaaacctatcatacagaatatgctctatctaccgatcccttaggggtaaataaaccccatgtcaaagatccctaaaaaggcgagggtcttaatgaagaggagggttgggaggtggttctggaggatgggcgtctccggccttcctaggcctcaatgttcatttttaaatgaaaaatgccaactgaaggctgaacattgtgcagtctttttcaaaccactttatgaattttctcacttgatcctcacaagtatgcccagtagaaaaagagaatctcctcataaaaaagtgatagttactaagtatttggaactttcttagcacagtagttctcaagcagggggcaactttggcctgtaggggacatttaacaagtctaaagatatttgtggttgtcataacaggggtgggagtgtgtactactggcatctagggttagagatgagggaagtcgttaaacatcttacaatgtgcagggaagcacctcccaaccccaaagaaagaatgacatgaaccaaaatgacaacagtgccattgagaaactctgcttacttgatgggcacacacaagactgaaggaaagcaaggctcagtgagattaagtgactttgccaacactgctaagatggttggacacatggcccaaagccttgttctttcctttataaccggaggacaactgctgttcctaaatgtcctgggactgtagagccagtaagaatagtggtgagcagcccactgcaggcacaggcaagggctcagggagcacagagagcacagaaacacgaaatccaaagcaggccttcagcactgccaaatgttaccaaattagctttgtcttatctccgcctcgtgaatatgtacagctacctagctcctaagatgtttatttgcacccagttactataaatacaacaaacaagaaacaacagccaaagactccccagggcttgtccaggcggtgctctagagaatatgggagtacaataaccagcacaagaggaagaacaaatctaattttgctctcaaatttgcagtcaccttaagttaccaagcttcatcagttttacttatttttaaaaaacccacttcagctattgctatgacaaatctctcaaatgtgtatgtatatatacatgcattataattaaatttaatttaaaatatgcagcagggctaagaaattgcaccaagctacatcataaaggcatataaaaattgctcctaagttttgttttgttttgttttgtttttttgagaagagtcttgttcttgtccaggctgatgtacagtggcacgatcttggctcactgcaacctcaccttcccaggttcaagtgattctcctgcctcagcctcccaagtagctgggatcacagtgcccaccaccacaccgcctaattttttttctatttttagtaaaggtgagatttcaccagttggctaggctggtctcaaacacctcagcctcccaaagtgctgggattacaggtgtgaccaccgcacccggcctcagttttttcaaaagcataaatttaaaatgcactttgaccgaaaagacagtcttctgcaagttccttcttgaagtttagagcatctgagcaaagctatctgatcaatggaaccaagaaaagtgaaggttttagcttattgcagcatgaacttgctttgggaaggatccaaatttatgtactcttttctaaaacttgacagactctttcccccaaattaagattcatcactcagaggagtttcctccttttctcatacactcaattttcccccatgaatatcaattcttggctttgcctcaatttggaaggtctcctcctgcctgcttcttctaaaaagaacaaaatccaatcctgctcagatgagagaaacagtaattgatagtaatttgcattcaacaaattatttcttgctgcttcaatacattatttaaggaaactgaatgtccaggaaaattacaccattatcaataaacacatttacttctatttccagtctatcagcatgggtccctttcagttatccaaagcaagagcactatatttcaatataagttaccatgcttatttacccatccaaagagtgattacaaagtacttgcagcctttcaatattgggcacttaattacagcaacccatgtaagtcaaaaagtagatttctccaaagcaaagtatatcttctttctcttcttttaaaaactcctatgagattgtgaaaatgttcaaacatacagaaaagttgaattttacaggaatactcctagattgattctatagttaacatcttgctatactggcaaaggcttcttaattacaattttggctatatcacttctttgaggatcaaaagcagcatttcctgttagtttagtacagtgctgtagtttaggcatttgtttccctaaacctcatgttgaaatgtgatcaccgtgttggaagtggggcccaatgggaggtgttttggtcacaggggcagatcctacgtgaacgcttgtgccatcctcgtggtaatgagtgagttttcactctattagttcctttgaaagcggttgttgttatagagacacaaatgggctaagatacacagtaagaaaggtctggttctgtatttaaaacatggaagaatttttaatcagaatgaagtgggcgttttctagactcaccagaaaataaaatattctcattttgagacagttttttttggtgagggcgtggagaattgaaaaagagaagtcagtaaagtaccatgacgaaaaataaatgaagtggcctagacactaacaaaatatctgagttaaagaaacagtatttggagaacagagaataattcacaaccatgcatccatacaatgcacactgatcactcacaccaactgtgcatgatactgtttagaaattctatctgttctagctctaacattgctaactctctagcagaaaatacacaggcagtaaaacagccctatagacattgtaattataggaggctcagcccagttataactgaaagcacatgaccggtaagatgttacaaaataatagctgtcagcaaaggagggcttataatttcaaaggatatttttattctgctttagtttaaggtgacaagaagctatttaagtgattacatttgaccaatgtagcactaatagccattgtaatcttctccgccaacaaaataagacaatttagaaacttgttttacttgtcttcacactttggaggtagaaatcatgaaacattaatctcatgattccataattatgctctcaaacagcccaagtgaaagaacaatcattctcacaaaatggtgcataatggttaaagcttaatgtcttgctaatgatcaagatgtatacacaacataaaataatagaattgcttgttgtctgctgaagttcttggcaatgctaaggtaagttatcattttacctttccagttctcaatagccagccctcaaagagcaaggggtggtaggacaacaggaatggtggaaatggtcttctctgtcggatccctcctaactgcagtcactcagtctagcaggctagcttccactgggttcttctgttgatctttggtggtataaaaagctcagcatctaaaagaagaaaggaagggaaattgtgacagacatactcttgttggagggcgctgaggcagtaacctaaactaaacaaactaggcaggtggagtttgcagcaataagaccatcagagccagagtcatgtgtctgctacccctgcaacctccaggtcagagcaaacacaacctggaggccctgcctgagaggagggactgcatttcaacctcaggcatgctcacccagtgattcaaagtggaaaatgttctgtatttcaaactggtgggaggggtggtggcagcagtcacatggctgtatactttattaaaactcatcaaattgtacacctgaaatctctgcatttcactatatgtaaagttagctcaatttttaaggaatagcaaaatgtgatagcacatattcagtaagtgaagttaaggacaggaactactttatgatgaaacttcgacaaacatgttgatcaataaagatgccccgctttaaaaaaagtgaatggagagagagggttaggaaaagattctgtcattgtaacctaaactcccaggcactctttcactta

SEQ ID NO: 5012 - DNA, 13932 bp, Homo sapiens
cagactgcctcctcaagtgggtccctgacccctgacccccgagcagcctaactgggaggaccccccagcaggggcacactgacacctcacacggcagtgtattccaacagacctgcagtgagggtcctgtctgttagaaggaaaactaacaaccagaaaggacatctacaccgaaaaccatctgtacatcaccatcatcaaagaccaaaagtagataaaaccacaaagatggggaaaaacagaacagaaaaactggaaactctaaaacgcagagcgcctctcctcctccaaaggacgcagttcctcaccagcaacagaacaaagctggatggagaatgattttgacgagctgaggaagaaggcttcagacgatcaaattactctgagctacgggaggacattcaaaccaaaggaaagaagttgaaaactttgaaaaaaatttagaagaatgtataactagaataaccaatacgagaagtgcttaaaggagctgatggagctgaaaaccaaggctcgagaactacgtgaagatgcagaagcctcaggagccgatgcgatcaactggaagaaagggtatcagcaatggaagagaaatgaatgaaatgaagcgagaagggaagtttagagaaaaaagaataaaaagaaatgacaaagcctccaagaaatatgggactatgtgaaaagaccaaatctacgtctgattggtgtcctgaaagtgatgtggagaatggaaccaagttggaaaacactctgcaggatattatccagagaacttccccaatctagcaaggcaggccaacgttcagattcaggaaatacagagaacccacaaagatactcctcgagaagagcaactccaagacacataattgtcagattcaccaagttgaaatgaaggaaaaaatgttaagggcagccagagagaaaggtcgggttaccctcaaggaaagcccatcagactaacagcggatctctcggcagaaaccctacaagccagaagagatgggggccaatattcaacattcttaaagaaaagaattttcaacccagaatttcatatccgccaaactaagcttcataagtgaaggagaaataaaatactttatagacaagcaaatgctagagattttgtcaccaccaggcctgccctaaaagagctcctgaaggaagcgctaaacatgaaaggaacaaccggtaccagccgctgcaaaatcatgccaaaatgtaaagaccatcgagctaggaagaaactgcatcaactaatgagcaaaatcaccagctaacatcataatgacaggtcaaattcacacataacaatattaactttaaatataaatggactaaattctgcaattaaagacacagactggcaagttggataaagagtcaagacccatcagtgtgctgtattcaggaacccatctcacgtgcagagacacacataggctcaaaataaaaggatggaggaagatctacaagcaaatggaaaacaaaaaaaggcaggggttgcaatcctagtctctgataaaacagatttaaaccaacaaagatcaaaagagacaaagaaggccattacataatggtaaagggatcattcaacaagaggagctaactatcctaaatatttatgcacccaatacaggagcacccagttcataaagcaagtcctcagtgacctacaaagagacttagactcccacacattaataatggagactttaacaccccactgtcaatattagacagatcaacgagacagaaagtcaacaagatacccaggaattgaactcagctctgcaccaagcagacctaatagacatctacagaacctccaccccaaatcaacagaatatacatttttttcagcaccacaccacacctattccaaattgaccacatagttggaagtaaagctctcctcagcaaatgtaaaagaacagaaattatacaaactgtctctcagaccacagtgcaatcaaactagaactcaggattaagaatctcaccaaagccgctcaactacatggaaactgaacaacctgctcctgaatgactactgggtacaaacgaaatgaaggcagaaataaagatgttctttgaaaccaacgagaacaaagacaccactaccagaatctctgggacgcattcaaagcagtgtgtagagggaaatttatagcactaaagcctacaagagaaagcaggaaagatccaaaattgacaccctaacatcacaattaaaagactagaaaagcaagagcaaacacattcaaaagctagcagaaggcaagaaataactaaaatagagcagaactgaaggaaatagagacacaaaaaacccttcaaaaaatcaatgaatccagagctggttttttgaaaggatcaacaaaattgatagaccgctagcaagactaataaagaaaaaagagagaagaatcaaatagacacaataaaaaatgataaaggggatatcaccaccaacccacagaaatacaaactaccatcagagaatactacaaacacctctacgcaaataaactgaaaatctagaagaaatggatacattcctcgacacatacactctcccaagactaaaccagaagaagttgaatctctgaatagaccaataacaggatctgaaattgtggcaataatcaaagtttaccaaccaaaaagagtccaggaccagatggattcacagccgaattctaccagagtacaaggaggaactggtaccattccttctgaaactattccaatcaatagaaaaagagggatcctccctaactcattttatgaggccagcatcattctgataccaaagccaggcagagaacaaccaaaaaagagaattttagaccaatatccttgatgaacattgatgcaaaaatcctaataaaatactggcaaaccgaatccagcagcacatcaaaaagcttatccaccatgatcagtgggcttcatccctgggatgcaaggctggttcaatatacgcaaatcaataaatgtaatcagcatataaacagagccaaagacaaaaaccacatgattatctcaatagatgcagaaaagcctttgacaaaattcaacaacccttcatgctaaaaactctcaataaattaggtattgagggacgtatttcaaaataataagagctatctatgacaaacccacagccaatatcatactaatgggcaaaaactggaagcattccctttgaaaactggcacaagacagggatgccctcttcaccgctcctattcaacatagtgttggaagttctggccagggcaatcaggcaggagaagaaataaagggtattcaattaggaaaagaggaagtcaaattgtccctgtttgcagacgaatgattgtttatgtagaaaaccccatcgtctcagcccaaaatctccttaagctgataagaacttcagcaaagtctcaggatacaaaatcaatgtacaaaaatcacaagcattcttataaccaacaacagacaaacagagagccaaatcatgggtgaactcccattcacaattgcttcaagagaataaaatacctaggaatccaacttacaagggatgtgaaggacctcttcaaggaaactacaaaccactgctcaaggaaataaaagaggacacaaacaaatggaagaacattcctgctcatgggtaggaagaatcaatatcgtgaaaatggccatactgcccaaggtaatttaagattcaatgccatccccatcaagctaccaatgactttcttcacagaattggaaaaaacactttaaagttcatatggaaccaaaaaagagcccgcattgccaagtcaatcctaagccaaagaacaaagctggaggcatcacactacctgacttcaaactatactacaaggctacagtaccaaaacagcatggtactggtaccaaaacagagatatagatcaatggaacacaacagaccctcagaaataatgccgcatatctacaactatctgatctttgacaaacctgagaaaaaaagcaatggggaaaggattccctatttaataaatggtgctgggaaaactggctagccattgtagaaagctgaaactggatcccttccttacaccttatacaaaaatcaattcaagatgattaaagatttaaacgttaaacctaaaaccataaaaaccctagaagaaaacctaggcataccattcaggacataggcgtgggcaaggacttcatgtccaaaacaccaaaagcaatggcacaaaagacaaaattgacaaatgagatctaattaaactaaagagcttctgcacagcaaagaaactaccatcagagtgaacaggcaacctacaacatgggagaaaattttcgcatcctatcatctgacaaagggctaatatccagaatctacaatgaactcaaacaaatttacaagaaaaaacaaacaaccccatcaaaaagtgggcgaaggacatgaacagacacttctcaaaagagacatttatgcagccaaaaaacacatgaagaaatgctcatcatcactggccatcagagaatgcaaatcaaaaccactatgagatatcatctcacaccagttagaatggcaatcattaaaagtcaggaaacaacaggtgctggagaggatgtggagaaataggaacacttttacactgtggtgggactgtaaactagttcaaccattgtggaagtcagtgtggcgattcctcagggactagaactagaaataccatttgacccagccatcccattactgggtatatacccaaatgatataaatcatgctgctataaagacacatgcacacgtatgtttattgcggcactattcacatagcaaagacttggaaccaacccaaatgtccaacaatgatagactggattaagaaaattggcacatatacaccatggaatactatgcagccataaaaaatgatgagttcatatccttgtagggacatggatgaaattggaaaccatcattctcagtaaactatcgcaagaacaaaaaccaaacaccgcatattctcactcatagatgggaattgaacaatgagatcacatggacaaggaaggggaatatcacactctggggactgtggtggggttgggggaggggggagggatatattgggagatatacctaatgctagatgacacattagtgggtgcagcgcaccagcatggacatgtatacatatgtaactaacctgcacaatgtgcacatgtaccctaaaacttagagttaataaaaaaaataaaataaaataaaataaaaataaatgaaaaaaaaaaaaaacaaaaacaaaaaaagaaaaaaaaaaaaaaaagacccaaacaggccaataactattagttattatcctactgaaaaagtgggacttcctgttatgaataagggaactaactgaattccctgctactaattaccttctgtagctatacttactgacaaaaacaccattaatttttttagataccattttttttaatactatgaatcttaagggaaaatggcttcacctcaaaaatactctgttattgcttggaagatagacgactttaagctgatgctgataaacttgtggcttccaaagtttccttactaattctaaacccaaaaggtgcctggcagtctctgctatgtctgtttcaagtaccctagctctatatcaggagacattttccttataaacagaaacatggtaaatcttaagtccctgcaattgaaatgcttggctgtgaatttgatttcataatcagagcggactctatagcttttcattcaatattcctgcaattagataaccaatcgcagcctagaaacaacctccaagagacccagtgacattgctcccatagttgatgcaacaatcaccatgatgacccaagcttaatcactctgatgaacactgctctcctgcctagagataccactgagtccagaagcaagactgtgagagtgcacagtgccacttcgccccatggctgaagatggtttgcccaaaatttatctcatcctccaacagaaagcagtaaaacaccaactgcagcaaccattttctttggggcgacaatgctattcccaaatcagaaacaactattacttcagaaggagaccacgtcacttcgtaaatgaatatatgctagaaagcgatttttcaacaactacagacaacaaactgacagcaaaaaggaaaaactcaaatcagaagatgatatggggaccgactttattaagtcaacaaccacctacagaaagaaattacctctctgactggcactacaaactccataacaagagactcattaccgaacatttcatgccagtgaaaattgggaatatttcatcaccagttactactgttctttaatagatttttccactgacatagcaaaagaagatatcctcttagctaccattgaacaggagatgcagagatctcaataacctctgaagtctctggcacactaaaggacagcaggctggtgttgctgacgctcctgcctttccacgtaaaaaggatgaagctgatatgagcaatataattcctccatcaaatccaatgtccctgctgatgaggctgtccaggtcactgattcattattcctgaggctgaaatccctcctgctcctgaagaaagcttcactactattccagaataactgcccttgaagaagagaaaataaccgaaattgacctaagtgttttagaagatgaaccagtgctgtggctacattaactgactctgatgagaagtttatcactgtgtttgaactactacctctgctgaaaaagacaaagataaacgggaagatactctgctaactgatgaagaactaccgagggagccagtatttggatggagagagatactgcaaatgaagcagagacccatctgttttgcttactgctgttgaatccagatatgacttcgttgtccctgcatcaatagcacaaacctagtggaagaatcatctacagaagaagatttgtctgaaactgataatacagaactgtacctaagatcactgagccattttctggaactacctctgtattagataccccagatataaggaagacacctccacaactgaaacggatatctttgaactactgaaagaagaaccgatgagttcatgatttaaaagcaacaaaagggataccatgtagaattgtgcaatagtctgccagctagccttaacatctaagaaatttttccaacaagcaaaaacctttagaaatgaagaatgtgggcatttaaggcaagtattcgactcaataaatgcagatgcttaggactacagtcatgtaacagatttacggaaacttagaaaaaaaaaccgcagtgtaagggtccccctagatcacaaagtttcaatattctaacaattacttaatgtaaaatttttcgtcctagccttcgggagtatgaagacagagcaatgtaggggctcatttctacaacatttaatgatgcatatatttagttaacagtcaatattatacttaagtgagaattaaggatatgaagagaagcaaataacctctccaaaacattaccatagcctaaaaagttctcccaaaatgcttgttctaagcattttttcattagtatttcatcagtgattctcttctatttaaaaaatttttaatcctcaataagaattaagacaattcagtaattgtttagcacccacatgtaagatacataagattttgatagggttcttggcacatgttagatacaaactaaagcaaaatgatattttacaaatagcatatttgtcagaaaaatgttctgtaaacatatacatcaatttaattttctttctgttaaatgtgttttctgaatttttgtccatgttttccaggtcttaaacactgaatatcacaccttcttatgactcttgttagcgattcaaggacataaatcttcattcttttctggcacagctacttaaatgggtctgttttcactttgctcatttttcttcaataaatctttttggcaacaactgatttactgtgtgtaggtgtgtttgatattctactacagacttctcaaattagggaaataaagagaaatgaaaattcattgtttgtttaaagaataatatagctctaatccccgaagtaaaattattctatagagattcataattgtattacactaaaaaaagaaataagaaaatgccaaaacaccaagtgaatgaaagatattatgtacggggggtttgtatagggatttcaccattagataaactatagactagaataatcacaacagtgtgttaaaacccagaaacaattacgaaacaaaaatttgttatacagtgaagtggacttcaaaaacatgggatataatattaatcttacttgaacaatcagtatttgggaaaaaaatatgttggaataataaacaaattttaaattctttttaagaccatactttaaaataaattctacatggattaaatactttaagtaaaaactaaaaccatacaaaaacttaggaggaaatgtacctgtatatctatccaaatgacctgagaaatgtaagcatatatgaaaaggtgataagaagattgataggtttgacacctgaatagttaaaattctgaaacaaagaaaattaacataaaattaaaaagtaaataactattttattttacatagcagtgaaaagattactatcatttttctataaaagtttctacaaatattttaaatgaacagtagaaattaacataattcatgaaacacaaattgttaatgaacagtgaaaaatattcaatagacatattcaaaaaattaaaataaagctagtacacatcagtttagccatttgaggattgacagtgattattgtacatattcattgttgactcattttccaactttctccaaatttctccagcctttctggaaggctggaagccaatttggcaatacatgtgcaagcattttaaaaattggaagttttggcccagttattttacatattttacatattttgccctgagaattttcctaagaatcagaaattattaaagttccagcagttattgagctctactactggtcagcatagttgtgtttatatttagaataacatttgatcctcatgatacccagaaggagaaacattactattctcattttagtgataaggaaacagaaaagctactcaactgcaccaagcttcaaagttaatatgtagcaaagaacgcttctaacccaggcagtcttcaccagaacccatgctcttttaatcactatactgtatgggccctcagatttaaatacaagatgttggcaaactcttacactgaagaatgtgattttacatgttcataagggaaaaacactaaaacaatctacaattgtagtcacatgtaattaattacacttctgtatacccatatgaaccatagcttgcatcttttaaaatggttctaaggaagaatatttaatcaaatggatgatatttcatacaactctaagcaaatttacacagtggtatgtatgcaatatacacatgcacaccatacacacgcaagcagaatgtctggattacatatatcacaatatataatctctaggaagactgcaggtgattttgtttcattctctgtgctttcgtgcgtttttaaatgctctccaacatccagaacataaactgtacacaggagaggatgaatgtttgtcaaccccattaactagaaacctggaagccaagctaaatctttcactcttacttgcttcccatacccaattaaaatttacaagtattttgagtgttccctatgtatcagacactactttatttttcatttacaagcatgtatatgcaccgactatgttccaagcaccatgaaagtgttttgagacactgtagtgatcaaatgacaccatccctgccttcatggaaattaatctaccataaaagacaaattttaacaatctcaaataatcacacaggaagaaatgactacatgcaaaatatggtgggtgtttcaagaaaaaacaaaagattataattgcagatttcacatacatttaaggccaagaaattgttctgagggggtaggatttaagctaaaatattgaaaaatgtggagagataaggaaacaactctccaaatccttgaggctagatttttcaaggatatgaacagacacggtatcagctggacataagatgaaactggaaaggtaggaaagagagaaattatacagtacttgttaaacatctggatcttatctgtttggaagatattaaaggttttaatcattttatcctcaaaacagtctagtactgagagcactgcctagctgaaaagcatcattattttataaactccaactatactctttcaagggctttgtttaggaaaataacttgatagtcccctttgcttggaggagatgggctctgaggcataaaccaaactgcaacagttaaacaattaaaaagataatgtgctgtaaatacaagttaacagaatttggggctagggcttagaaataacaagaagaacagcacactgcaattggttagagtccaggaagatgagtgtccagtgagattcctggtggtcaatgaactttttccaagaaagcgtgcctaattatgtgttttaccttgcgccatttcaaagcaaagttctccttgccctgaaatttgattaaacgtctgtaagacacaaggtcttaaatatgcactcttgaaaaaataaagaaatataggaggcaaagaagaaacagataagtaattagagaatgatatgagacagtctttcttcccaaatattctaaatagtgatgacctgagaaaggagtgagggcatacagtgagtagacatttagaatagtcacatttcacagataaccaaagtgaaacgaaaagtcactggccccagataacgatgctagtaagtaacaaagctcagctccagagactgagtggctccaaaattcaagttcaaatcacactgctttgtgtgaactgttgaataatgatcattccatctctttatcataacccttccccttgatccattcctgttgccactgctttgttaaggctaatggctgtcttgtagctggtcatctcacctctggtcttgtatttagcaattaattaagccccacagcactcatctctaaaccgttttgctcactccctgttcccacatccttgccacagtcatgaagaataagcacatgaaccagtcagagcaaaggggacaagaggagtgctttggggagactctggggaataagtttctgaaggaaacttctgtctaaagacattagggccgggagctgctagaatcaccttggatgacaaggagacaggttgcttgacagtaagtgaacactgaggatattagagacaagaaatataaatatgaaataataaaagaatgtggactagtcacatcctgtagcaagcctaactagtctgcttatttacctgagacaatgcatttctaattaaacaagtttgggttatgttttttgttgtttgaaaccaacacaccttaaaactgacaacccaagttatttcaagtccctgtgtctatttatttatttatttggtagagacgggtcttgccctcttgcctggaatggtctcaaactactggcctcaagcaaccctcccacacagcctccctaagtgctgagattatagtgcctgctgttctcccagtgccacagtctcagtggtaaatatcgtctttcatattcacctcacatgctatcttctttaaccacccctcggatgattacctgttgtgtatctcactatatacattctttaatcacactacctataatattcattgtatttacttgataaaagatcctcctgtgtcacaagataatcctacccatagtttctctgacacatatatctctgtccaaagttccctctgtcctagtgtaacccctgtttatatccccactgtaccccttccctacagataaccttaccctggggcacagcactatcctccagtcacagggagcttctgaccacaaaaagagagggagagaagccaatcttaagaggcaaaactcctgaccatgaagaaagaacgttaccctgaggagattcccaaagttaaactagctcacatgaggatgcattaaagaacactcataacttcaaggcaccaagaacagtgggaaattagccagtgtctttgtagtatatgtgcttccaccaattctacctattgcaaattaggagtaacaaaggatacatgaattacattttgagtctatggcctttattttcattacagcactatggtgtgttgttttacttttctcacatgtatttcaaacataagagaaggctgaattaaattggcatttcccttccctcaaatttctcctcttctaatattctccatctcagcaaaaggactatcttcacagttgtccaagccagaaactggggatcagccttcacttccctctcatttccatacctaataaatacaaagtttttaccgtggcattctaaatacagcagaaatccattgccctccttgccactgccatttctttatccaaatctctatcaagcaaaagtggaagttattacacaaatatatcatatcacttccacctcctaattcaaaaaattatccagtgacttccaccaactttaggatgaactccaaaatctttacgatattcatcagagtcaccacaatgaaaccctgcttatctatgcagccttgtaatatgctactatcagtttctgttctgaaattcaactatatagatctcattttgatcatccttagaacataaagttatgtcttgtatcaggtcaccgaatgtgctatgctctccctgaaaaattctgtaactcaccttttaaagtacaccaaatgtcacttggtcagttatatcctccctggaccctaaatttatataagcccctgtatcttctgtcatatattattcacagtacactataccttgctttatgtagcatccataattattcaattgcatgttatattacttttttcacactactgtaacaaagtgccgcaaactgggggttaacaacaagagaaatctatatcccccacagttctggggtatataagttgaaatcaggtgttagcaggaccatgttctctctgcagtttctaggggatttttttcttgtgtttctcctagcttctgggaaccaactgctggcaatccttggcattccttggtttgtaaacaggtattccactctctgcctccttgtcacatgaggttctcctttgtgactccatgtcaagatgctctctatttataagtacaccagtcattggattaggctcatcctaatccattatgacctatcttaacttgattacatctgaaaagacaccatttccaaatttggggtctcacaattacgggggttaggacttcagcatattttgcgggggaggacataatttaacccataacctggtaatgcttattttccctcccagactgtatatctgataattaggatgatcacatcatttgtatgaaaaccagaacgtttttgagactgaaagagacaatataataatgactccaaaacaaagctgtaaaccagaatgtcctaatagagctatccacactgtattcaaagcaaagaaaccgacactattgttcagtgctcaattctgagagcttggaacacaatagatgctcaataaactctgttaaataaatgaataaaatgtaccagtaaatgaggaaatgatgttttcatttattgactgaatgctctcagaagagagatggtctgtactagatgattagaattgaataccagtggccaagacaaaaaggagcttgctggttgcaagctggaaaaggggaaggtcaaaaacacgaagcatg

SEQ ID NO: 5013 - DNA, 15409 bp, Homo sapiens
ccacgggcagacgcaggactgggaccaggagcgccgggcagaccggcaggaggctcccaacgggtgcacctcttcgtccaccacatgggcatggagaaggttccggaagaggtgctgagccgggcaccctgttcaccgttgagctgctgcccaagcagcttcctgatctgtgagtggttccaccagcagaggctgggctgggggaccgccccgggcccctcacttgcaggagggggagctcgtggggcagcagcccctttcctgggagtcctgttggttttccagtgtctgccttacccccagccgcaaggaggaagccgtgcgtggactagaggaggcgtccccgctggtcacagcatcgcactgggccggcctgtcccgcagcccctctgcagaggtaggtctgccccaccctccagcttcccctctggcccccagccccaccctgcatgagtgctcagggaggctgcccctctcagtgatccccagcaggttcctggagcggcagacctacaacatccccggaggccgcacaagctgaaccccagccagaacgtggcggtcagggaggctctggagaagcctttcacgtcattcagggcccaccaggtagggcccacgccgggggagccgcaggctgccttgggcccagggacccacagggtgggctacaatctcctattctctggctgcaggtacagggaagacatcgtgggcctccacatcgtattctggtttcataaatcaaaccaggagcaggtgcagccggaggccccccccgtggggagaagcggctggggggtccctgcatcttgtactgcggccctccaacaagtcggtggatgtcctggcaggtgcgccggggtcggcggtgggggcctttgggagctggcacgcggggcaggactcacgtcccccaactaccctcaggactgctcctgagaggatggagctgaagcccctccgtgtgtacagtgagcaggctgaggccagcgagttcccatgccgcgtgtgggcagcaggaagctgctcaggaagagcccccgggaggggaggccgaacagagcctcaggtgtgcctgctgtctttggggcttgggcggagtggggccgagctgtccaacagtcctgtgtaggtgggtctcactgagctctgcccccgtgatggccctgcgtggacaggctcactgtgtcctgtcccccaggagcatcaccctgcaccaccggatccggcaggccccaacccttactcgtcggaaatcaaggcctttgacacccggctgcagagaggggagctctctccagggaggacctggtctggtaagtggcaggggccagggggtggagctgcctgcagctgggggccctggggtgacaagcagtgtccccggcaggtacaagaaggtcttgtgggaggtcggaagttcgagctggaccggcatgaggtcatcctctgcacctgctcctgtgcagccttgccagcctcaaaatcctggacgtgaggcagatccttgttgacgaggcaggcatggccaggaacctgaaaccctcatccccctggtgcagttcccacaggccgagaaggttggtcggcgggggtgtgggcagcatgagcaggcgtccctggcacagtctcccacctggggtgccctggtgtgcagacgcgggtgtcgtgtggggctggggtccctctgggtctaggggtgtcagggcaggcctgcctattcctccaggtggttcttctcggagaccacaagcagctgcggcctgtgtcaagaatgagcggctgcaaaacctgggtctggaccggtctctgttcgagcggtaccagaggacgcacatatgctggacactcagtaccgcatggtgagcccgccccactcagccccagcccacctgcagcccctggggggccacaaccccgcgtggcagcctctgaccagcgcactccttgcctgcagcatgagggcatctgtgccttcccctctgtggcgttctacaagagcagctgaagacgtggcagggcctgaggaggccgcccagtgtcctgggccacgctggcaagggagctgccctgtcatctttggccacgtgcagggccacgagcggagcctgctggtgtccaggacgaagggaatgagaactccaaggccaacctggaggaggtggctgaggtggtgagtgctggtgcctgtgagtcagggagggctttctggaggaggtggctgaggtggtgagtgtctgtgcttgtgagtcagggagggcttcctggaggagggcaggagagacaccagggtccgctcacctgccccctcggctcctcaggtccgtatcaccaagcagctgaccctggggaggacctagagccccaggacatcgccgtcctcacgccctacaacgcgcaggcctctgagatcagcaggcccttcggcgagagggcatcgccggggtggccgtgtcctccatcaccaagagccaggtgaggctgggggctcgtgggtggggccgggagggtgggcgcagcggcagcagggcctccctcccatcccgcagggagcgagtggcgctatgtgctggtgagcaccgtccgcacctgtccaagagcgacctggaccagcggcccaccaagagctggctcaagaagtttctgggcttcttgtggaccccaaccaagtgaatgtggctgtcacgcgggcccaggaggggctctgcctgtcggtgagggcggggctgggctcttccagggtgggaacacaggtgaggccagggctgggtagggagctgccgactcctgcctgaccctgactccgacctgaccctgactcctcccaccgaccctgactcctcccacctgactctgactgactcccatctgaccctgactcctcccactgaccctgactcctcccacctgaccctgactgactcccacctgaccctgactcctcccactgaccctgactccgacctgaccctgactcctcccacctgaccctgactcctcccacctactctgactgactcccatctgaccctgactcctcccacctgaccctgactcctcccaccgaccctgactcctcccacctgaccctgactcctcccacctgactctgactgactcccattgaccctgactcctcccacctgaccctgactcctcccacctgaccctgactgactcccactgaccctgactcctcccacctgaccctgactcctcccacctgaccctgactgactccctctgactcccaccctcacaggagaccacctccttctgcgctgctgccccctctggcgtacctcctggacttctgcgaggctcagcagaccctcgtgcctgccggccaggtgcgcgtctcaggaggccaactatgccttcctgaagagccctctccacctgcaaggtgccaggactggagggaaagtccagggcccccccaccctccccaccaccctccgccatcagcctgcctgggcagcctgcctcctggcctcaggatctccctggggcaggaagtgggtggacttggaggagaacggcaagggccggtccccacactcttgctcctcctgggcatctggggacaggaacactctcagggtggccaagaggggcttccttgggaccagtgtaaggaagttctgctgtccctggaagtctcagaaccaggaaggaaaccctgtggaggctgccctttgacctttggacgcccctgtaatcactctggatggtgtctgtggagttcaggtttattttctatttaaatgaacaaaagccagcatcctgccgggcgtggtggctcacgcccataatccagcactttgggaagcgaggcgggcagatcacctgaggtcaggagttcgagaccatcctggccaacatggtgaaccccgtctccactaaaaatacaaaattagctgggcgtggtggcgggcgcctgtaatcccgctacttgggaggctgaggcaggagaatcgcttgactccaggaggcgcaggctgcagtggctctgatggtaccactgcactccagcctgggtgacagagcgagaccctgtcttaaaaaaaaaacaaaacaaaaccagcatctgttactggaacagagacctcagcccaagctcaggaaaggaggcctccctgggagagggggcctttctcccaccatcaccgcctgtgtccttcagggctgctggagggcagcccaaagccaggggcccaccccgccccaccccaccccaccccacctctgaaatgtgaaaagcctgcactcttcctgtgggctgcgcagtgggctcgggggttgggggtgccggggcgatgcttccaccctggactgagtgttcggggcagcctgctcggcttatgtttctcgcacgctcacccgcttcagtgcggctctgtccctgctgccgcctccagtctgagggaggggcttgccccaccttctacattccaatttttatatctttgaattatgtgttagatattaatttaatgataaaaccactctgaaagctcttctcacttctgggtgtttgggtctggctggggggcaaaagtggatggtcactgtgcttggtacgcagttgtggaggcttcgagggcctactgcagagcgctgggcgcaggggcgtggggagggcggttttgggacgcgccgtggaggccgtcgagggcccactgcagagcgctgggcgcaggggcgtggggagggcgttttgggacgcggccgtggaggccgtcgagggcccactgcagagcgctgggcgcaggacgtggggagggcagcgaccccccctgcagggccggtgtctccggctgcctgtgtggggagggagggccgtgcctggtgtggtggggacaagccacagctccagagctgctccggtgtcccaggctggccaagtccaaagtccctgaggccaccagccttgactgtcctgctggtccccttttaaagctgctccccaggaccccctggccgctgtggactggggtccctccgcacctgcccatttgtggctgcgtccacaggggctcctgtggcctcccagagccagctcgggggtagatggtcgcgggggctatggtcactgtgggaaaagaggttctgggcatctgtggagggggggtggagcatggagtctccaggactgtggccccgttggtgtgctggacgggccctgcttgaagaccatgtctattcttggaccgtcatgaaataagagtagttctgcaatagcttggaagtgcctgcagagaggatgagaaggcgcctctaggaagggggacttggggacctcacagcctgcagccagggaaggcttctgggaggaaggggcagctgcggccctgaaggtgagcgtggggggacgcaggggctggacgcctagcaaaagcagctgatcctggaggagagaggggctcagggccgggaaggcccttgaggaacaaaaggtggggcggggcatggaggggcacgctgagctgctcacagccagggatccccggtggtgctgctgcctcctcgggcgggcgtgcgatgagcactcgaggctgggcaggggatggtgggaggcatcacggcctaggagtgtcatccctgagggagccccacaagccagggaggtgggtaaggaaggccggagcccggtcacgggatgggggtggtgaggaggggcgggggctaggaccgcagaggccccgtggagcagctttgtcgtcgtcgttggacccgtaggtgtcaggggctggtacttcttgctccaggctcagcttcttgggaggtccggcctgtggctccccctgggaaagagcaggagcagaaggcctggggttggcatgttttgagccaggaaaaacactggtggctgctgcctttaaaacataaataggttgcttctttaattccatatgtgcatttacactcttctttattagtggataaatattagaaatcatctctcagacagagtggctgagggcgggcccctccaggggctccggcttggtggcagggtgaggctgtccctccagggctcgtacaccagcgtggaggtctcggccctcttgtggtgaacttataggatcggttgggcagcaggtttcggacgtcgaaggtgcaggcagcccggggatgacgccacactgggcgcactcctgctgtgtccgcgggtccagcagcctgaaggcaactcatactgctccgatgtggctggctggatggtgacgaaccagcgcagccgggccagtcctggtgagccgccgacgcctttcggtcaaacacgacaggcatcttggtgctcagctgagccagatgtgcgggatcttggtggcactgacatcagacaccaggcggtgcttgacggtagccgccccggcaccatcatggtcaggaagctgtccatgacggccgacacgtccgccgccgccgctccaccagcgcccagtcggccaggaagggccgtgggtctggcgaccggagcgggcatccagctcagcacggccatggtcgagctgttccaacaggtccccgagcagcagggctggatcttggtctgagctgtgcccaccttcttcatgcgctggaacttccaggggtcgtgagctggaacaaggcgctaggcagcaccagcgggttctggtcgcccagggccaggtgctgggcaggacctcgatgtagtaggagcacttacgcagcagctgcatgcgggcgtggtgggcttgagcaggtgcggactcaggtccgaggtcaggaactcacgcagggcattgcggcgccggtgtaggtcttccacgcctctggttccagcagctgctggtcatctgcctcctcctggccaggaaggactggggattgcccagcttcatcttgtccaggcccaggcctgccacatggtgctcattatccgggagctggggggagggctgggtgtcagctgccaggcaggctggcctccctgggctgtggcatgttcgggggatggattcagcccactgaccccatgctggacctcgtccttcttcgggggcacaactcgatgggaagaggctgcctggagggctggatgggcagctacagatctggacacagtttatactgaggggcaaaaacctctactgacaaccagtggctgtgggacaggacagggaagaactaggactgcggacttctggccagaaccgcctgaccttggccttgcaagggccccagttcctaaccctgctgctgaaaggggttgctggcacccctggggccgtggagaggggacggcgtggtcctaagcagcacaggatccccctcggggacatcgcgggccatcctcccgctccggttctccctggggacgctccacgcctcaccgcagttgagggcacagagacaggcctcaccaaagacgaggccagctggctggtcagcatgggaggaggcgcccaggcctgggcccggaggagcagccctcctcccacgctgtgggccctcgctgtgacccgggatcctgtccctggtgagctcatggactccacaagtgacactccatttcccaatggagcctgaggctaagaagcttggttcttgttctcatccagggcttgagcccagtgcgagccgagtctgaccctctgtccgtgggtgcaccggctgagtgcagctgtggccccaggtctgccgcagctccctggagagcaagccgcacccctggttgctgccccggctcccagcaccctggagatctcaggttgtcacagccacttgggccttggacgacccacaaatgagagcaagcagttgctgagttccccagggccacacaggtacgtggtgaagtcatatctgcccggaagggttgcccttttgggcgtgaggcagatatgacttcacgagcgcactcctcgggaatcctcgagaacaggcccctgggggcagcagggagtgtgtctggggtgaggtgccagctgaagcaggaccccaggaccccaggcctaagccctgctcttgctggaggctggggcggatttaccgctggagggaaaccgtgcctctgtgacgtgtgagggatgttttctagtctccagcactgcccaggtggaacacccagagaggctggtcgtgaacccggaaaggtggttctgagccctcgctgcttcctacacgccccggtcccaggcccgcttccctgagaccaccaggtgccccactctaccccctccaccacactccccttggctcccctggcccgggcccacctccccggcgctctgcctgccccttaccttctcgagacccccagccctcctctcccggcccccgccgcgccccaggaccgcgcccacttgccctgcctctgaagcggagccgcgcgcggacttcccgagcccagcctccctccgcactccgcgggttgccctggggaccagcggcctttgtgacgtgcggcccgggggcggggcgggggtggggacccgggaccccgagccgagtaatcttccaccgcttcgcttcctggagagccccagacttctgggggcccgcgtccccgactgaggggcacggcgggtggctggtccaagagccaggctccaaggggggttcccgtcccggagcccttcgcgggcgcaccactccccacgcacccccggcttcgggcggggcgcaggagcctcgggtactgggagggagttcctgctcaaccccccagtccgagcgcactcctcgggaatccctcgaggaatttgggagagaggcagtggccggtgaccaggcggatggaccacccagcgcctggcagaggagaggggcggcttcccccgccgcgggctctgcccagcaaggccccgcccattaagatgccacccattacaggctcctcccaccgcaggctccccccaccgcaggctcctcaacacaggctcctcccaccatgggctcccccctcccccgcaacggcccctcccatcataggtcctcccaccgcgggctccccccaccacggcccctcccaccacaggctcctcccagagcggctcctcccaccgcgggctcccctactacggcccctcccaccacagggtcttcccacccaggctcctcccagcgcaggctcctcccaccgcgggctccccccaccacggcccctccctcataggctcctcccactacaggctcctcccactacaggctcctcccaccatgggctcctccacctggggctgcccaagctcaggcaccgacctgactctggataaatggggtctccaagctccagggagccccgcaggggagctctgaggccatctggtcccgtctgtatctgttcgttgggctcagggcctctgggatccccccgttcccccacagcacaccccagctagctggggtctcctggggtcacaatcttagacaccccaaggtgcccctccttcaccttcaggaagtgctggaggaagacaccctttccatcctcctcatctccacccccacggaggtcagtgctgggcctcttccaggatgggcgtctttgagcccctaccaggctgttctgtaacttgagcccccccctcctcccggtgaccccaccctggaagagctttcccttggtgcatggaggccccggggttaggcctggcaggaagtgggtggatgtgggtggttttttttttgagatagcgtctgctctgtcacccatgcggcagtcttcacccccggggctcaagtgatcctcccacctggtctttctgatccttccggattacaggtgtgagccttgcacccagtcctgttgggtgctgttctgccctgccctccctgcctgggctggaactcaataaatgccagctattgttattgtatttagggctccaggggacaaagccggggttgtttggagaagggggtgctgtctgacgcgagggttgggaagcagtaggagttagaccccttacccccggccctgcagcccactgacgagaagcggggtgggggcagagcagcctccccttctcttttggggccaggcaggtcctggtgtctcccctctcctgggctccaccctaccccctttctttcaatttctgatttctaatcaattttttaaagttaaacttttggccaggctcggtggcgcaggcccataacctcagcacttgagaggccaaggtgagaggatcccttgaggccagaagtttgagaccagcctcggcaaacagggagacccctgtctctacaaataatttgaaaaattagctgggtgtggtggtgtgccctgtggtctcagctacttggaaagctgaggccggaggatcacctgagcctgggaggataggctgcagtgagccaagatggtgccactgcactccagcctgggtgacagagggagacctgtgtctctaaaaagaataataatggctgggcgcagtggctcacgcctataatcccagccttcgggaggctgaggcaagcagatcacctgaggtcaggagttcaagaccagcctggccacatagtaagacccagtctctactaacaatacaaaaattagctggacgtgatcgagacctggtgaaaccccgtctctactaaaaatacaaaacactagctgggagtggtggcaggcgctgtagtcccagctactcgggagactgaggcaggagaatggcgtgaacctggaaggtggacttgcagtgagccgagatcacgccactgcactccagcctgggcgacagagcgagactcttctcaaaaaaaaaaaaaaaattagctggacgtggtggtgggcgcctgtagtcccagctatcaggaggctgaggcaggagaatcgcttgaacccaggaggtggaggttgcagtgagccggattgtgccactgcactccagcctgggtgcaataagacagaggcctgtctcgaaaataaaataataataataaagttaaacttttacttttaagataagtatagattcatctgcagtttaagaagtaacacagaggtcccgttaccctctatccagcatccccagtggtagcatcttcaggactgcagtgcagaatcacgccaggaccttgacgtcgatacagacgcaaggcagtgcacccccacgggaccctgacatgttctttacagccacgctgctccctcccacctctcccagccctgcaaccactcatctctccggctctgtctggtcatttcaagaatgtcctatcaggcaggctttcagtatgcagccttgggactggcttcttgcgctcagcatagtcccctctggcagggtcaacagtcactcctgttcactgctgggcaccaggggccagtttgtgctcagtttgctcaaccctgtttgtggccaccagggcacgggcagtgaacactttggatctgttgtcctggtggggacaagctctcttccctgggccctgaggatggtgaagcctgggggtagtgggccagtcttgggggagagaatgcacgctgaccactgagaccctcagagctgtgccctcagacacataaacccggatggggggtggcctgatgtggcagagctcctgccacaagcctcatctgaacaccaggaagggccctgcaccccatccccctggtctgtgtcctcactgccatgtaagctcagtgctcttacagatggggaaactgaggcacagggaggttcagcactgtatcccaaggtcatgtggacagtgagtctgacagcaggattccagccctggtcatttttattttttgagatggagtcttgctcagccgcccaggctggagtacggtggcgcgacgatctcactcactgcaaccactgtctcccagattcaagtgattctcccgtctcagcctcccgagtactgggattacaggtgcccgccatcatgcctgactaacttttgtattttagtggagacgggtttcaccatgttgcccaggctggtcttgaactcctgacctcaggtgatgcacccgcctggcctcccaaagtgctgggattactggtgtcagccaccgtgcctagccttttcttttttaaaaaaatagagatgggggtctcactatgttgcccaggctggtcttgaacccttgggctaagcgatcctcctgcttggcctccccagatgctggtattacaggagtgagccgcctcaccggccaagccccagactcctgaccccgtccagactgatcctgtacccaggcccctttcccactcccctctgtgccacccacccggttagggctgagggaggaggtgaggtcatgtgggggggcacagcaggcagggaaggggctgctgacaccgacacctggcaggggccctatgctggctgtgttgcgcctggtgggtgaggtgaggaaggggtggacgggcgggcacaacttgggggcagcgggacagggcagctgggcatgcggggccggggattctgaggaccaccggggagagctggataaagccggcctcggctgcctgccgaccacactcaccctggcatgtgtgcgtgcaagggcagcaggtgcaaggagggggaagatggggcagacgtggggagctgatctgtggcaggtggggcggtgggggtgagacacgccggggcagaggcccaatggggccctaacctgatggccaggcctgcctctggttccagctgggcatggaatgtgctgagtcctgtgccagatcccgtggctctaaggggcagggagtgtctgggaggaatctgcattcagtgccctgacatctgaccctggtgtggtgggcacaggagctttccatggcctgaggaggcctccctgggctctgcggccttggcgttctagcggggaagagtcacgtcctagggaggatttgggagactggtagccacacctgtagtcccagcactttgggaggcaggaggatcgcttgaggccaaagttcaaaaccggcctgggcaacatagtgagagcccatctctacaaataataaaaaattatctgggcatggtggcgcacacctgtagtccggcaggaggacggcttgagcccaggagacgaggctgccactgcactccagcctgggcgacagagtgagaccctgtttccaaaaaaaagtaaagaaaagaaatggtgggcaaaagcctcacctgcacgtgaggagacggcggtgggttggggaggagacggcggcggggggagtggaggggaggagacggcgggggtgggttgtgggaggagacggcgtcgggggcgggaggagacgggcagcgggtggggggaggagagggcgggggggcgggaggagagggcggcggggggaagcgcgggaggagaaggcgctggggcccctgaaggccacccccaatgtagtatttacaattctccacatttctcaacaccccccaccaccccagcagggcacctctctggtgcagagcctgccctgagcctggcgatgtccagtctccagggcccctgctggctccaggctatcagcccggacacagcttggctgctggggtgccctagagccaggccacgggtgtcactgccaccccacaatgcacacaccagtccccagacgtgggtttctgagaagcccatctgtgactccagggcaggcaggtgcgaggggcttgtcattgctggacactggtcacgcctattggagggatgcattcagccacacgcatgaagtgggggctggatgcgtgtgagatgtgggaaaggggcgtgaggctccctgaaggccacccaggtgcgaaggggctgctgggggaggccggcaggaggagtgagagactgcagatggcctcaccccaccccgtgcctcaggacccagaggggaggtgggaggagtgagagactgcagatggcccccccccaccccactcaggacccggaggggatgtgggaggagagagagactgcagatggccacaccccatcctcctgcctcaggaccctgtaccgtgctgctgggttttgctgggatttgccccccagtcctgccccgatctggggacctacctgagcgggcagagtttgcttcagcatggggggcttggcgctgtccagggagagggtgggaggtccccagccagggactcacccgccccccttctccgtgtgctcatccccctgaactggggccaggcgtccgcagcctccacttcccgcagtggcctttgggtatggcctgggcattgactgactcagaagccggtcatcgggcgcatggggcatctgggtgcctggcctgcggccgagctccctgcaatcagcatctcgtttactgcatgaaagccggggtgctgagagccccctcactcgcctgtcctcagaatttactgagaggccggaggctcggcacctggtgcagggttaatgatgttaaaatatctggccaacattaaataagcaggcaatttttcacctgagtgcagctcaggcttggcaaccactgcaggtctgaacagcagcgcttctccgtggaacccccacttctccgtgggcacgggcggctgttgactgtggtgcccttgggcatgggccaggcctgactgggcagagccattccgcctgcctggccttgcagagggcgggagagaggctggccctgcccaccccgccctcctcgggcccctctggagcccgcccccgccccagcccaagctgccctctgccgtcgggttggggaggggacgtgcactccagacgccaaggaggtcgaggacaggaggtgctgtcggtgtgcctgaggcaggggtccgccctgcgccccacccagccccaacgccagcccggacgccggtgggaaccgtggcctcctggatccaggggacctctgagtgaccgcagggccggggtcccctgtcaccccaggccagggcagggagcgctggacaccgggtcccaccggccctgccagttcctcttccggctcgcgggctcccatggccctcgggcccagcgtggtgaccccgggggatggagccgttctcaggaggcggctggccttcctgtccttcttctgggacaagatctggccggcgggcggcagccggaccatggcacccccgggtccctggaccccaacactgacccagtgcccacgctcccgccgagccttgcagccccttccctcagctcttccttgcgctctatgacttcacggcgggtgtggcggggagctgagtgtccgccgcggggacaggctctgtgccctcgaagagggggcggctacatcttcgcacgcaggctttcgggccagcccagcgccgggctcgtgcccatccccacgtggccaaggcttctcctgagacgctctcagaccaaccgtgagtacctcggcctggagtcagagcctgcctcgcccccagctggggagtccagaacaacggcaggattttgagtggaaatcgc

SEQ ID NO: 5014 - DNA, 14118 bp, Homo sapiens
aatgctcttctgatttgtttcccgtacaggcaaggaggcttgggtagtgcagatttgtgatttcaatctttgaaagctctgatgtaatttagaaatgaaatccaatcatgagtccaggagagaacgcctgctgtaatctacactgttgctgggactgcgcattctgtatataactgtttggatgagtgacagatgattgtccagactaggacagcggcatgaacatgactttggttggattgcggatagttagggttacctctgaatcgtgtagcttttatgagagcagctgtgcagtgaatccacattaatgccttgtcgtggtgccattcccagcgcctgacgatacgctctctattgtcttattctggcaggttttgacgttttaaattttttaaagaaattttattcctggaccaaaaggtttggttaaccacccccctcttacttgctttcacattttgagtgtccaaggaaacagaaaggaatgagtgtgtgacgttgctgcacgcctgactctgtgcgagcttcttctgtgtatatattttgttttatttttttccgtgtatatttttaatcccgacagaacacatgtgagatttctttaaaatggattaaacgatttcttcagcctgaaaaaaaaggttttaaaatgttttcttgtagttttgtttggttctaaacaacaaataggttttaatcactcgaatggaattatattgtgtattcattgaataaattttttttgaaagtaagcttctgaaatcagctgtgataccagtctctaagtctcatcatgtaaagtggtggccaggttcagatttttaaaataaacttaggagattggaagggattgactcagaggatcctggttcccaaagaacaatagagaattacttgtaaatcgtaacctctgctttcctcccttactggcagggcgtaggcatcgaaattttggttgtatttgagcttatcttcttataggggtgatgctattatacctcacggagagaaataaattctcatccagctctacaacttttcattcagcttgaattccattcctagggaagcagtcttgagtttcaaagcaaaccaagttatatatatggccctcctctggtaattggttctttttattttttattttttttttttgagacagagtttcgctcttgttcccaggctggagtgcaatggcgtgatcttggctcactgcaacctccgcctcccggtttcagcgattctcctgcctcagcctcccaagtagctgggattacaggcatgcgccaccacgttggctaattttgtatttttagtagagatgggctttctccgtgttggttaggttggtctcaactcccgacctcaggtgatccacctgcctcagcctgggattacaggtgtgagccaccggcccttctctttttttttatacatgtggaaattattatatgaactttgaataaccaggtaacttctgcttctctttagaatgtatgttaattttccaattttctattagattattaagaatttttaatgttcatctctagtaatattgtccttgtgaaaagaaactccttttcccaggtattgggctgctataatgtggccctcgaagtttgttgtagtaaaataagtggtttataaagtaccgaataactaaataacacacacaggtttcccttttatctgcttatcttgtatttggcgtaccaaaacgtttttctcctaaatatacaactgtgcatgatagtgggcaccatgagggtgaacagtaatgctgtttgtctgcataggacattttggctttaggagatctgcctcttttatttatttcattgcctgtcatgtctcgctttgttgcgttttgtttttgcttttgttttgtttttttttaagacggagtttcactcttgttgcccaggctggagtgcaatggcgaacctcggctcaccgcaacctctgcctcccgagtttgagcgattctcctgcctcagcctccaagtagctgggattacaggcatgtgccaccacacatggctaattttgtatttttagtgagacgggttttctccatgttggtcaggctggtcttgaacttctgacctcaggtgatcaccacctcgtcctgttggcgttttttaacattttattcatcctaaagccctctagtgtacactttggctttttatcaaggcatccagaagcttgcttctgcacagttcagctaagtaatctaaaccaaaaaagagtaatttttaaaaattattatttaggccgggcgcggcggctcaacctataatgccagcacgttgggaggctgaggcaggcggatcacctgaggtcgggagctcagaccagcctgaccaacacggagaaaccccatctctactaaaaatacaaaattagatggtgtggtggtacctgcctgtaatcccagctactcaggaggccaaggcaggagaatcccttaacctgggaggcggaggtcgcggtgaagcgagatcacgctgtcgcactccagctgggcacaagagcgaaactccgtctcaaaaaaaaaaaaattatttagacgcccattagatccgcaaaactaattttaaacaaaagtgattagtttcccacatctgggggatatgatcaattagaaatggcatgaggaagatagctttgcccaagctggtgtttcatttttggtttttgagacatgctctatcacgcagggtggagtgcagtggggcaccatcgtggctttctgcagccttgactctggggctcaagagatcctcccacctcagcctcccgaatggctgggcccacagccactgccaccacacccagccaacgttttgatcttttgtagcgaccgtctcactgcgttgttcggctgcaagctgttgtttcaaacagatgaagttggaaagttcttcagcttctccagagtgtttttttgaatcaaggggttgtggagcctacatgtaaatacaagtgtgccttgagttaatctccgggaagacttagaacggccgtgttgccagagctctcctagttagcctgcaggatgtctgaagtccgtgtccgtctgacatgttaccggaattaacaaacctagggacggtgatgctccttcatgtggctttctggctctctcacctgccactcagtgccgctgtgacttagagccagagttttcaggagacctccaacgtgtccgttgaaattcagggtaagagttgagagtttccctgtttgttctaagagttcttaccccaacctcaggggaaatcaatagtaaattactctgacttcaatgataataaagaagtgcccttgcctcatcctctttatataaagcaaagagccacatggttcaaaaatgaaaacaatatgaaaaggtattgtaaaccgggtaagtgctgagacaagtctcgcccatttagaggtttattttgccaaggctgaggatgtgcctgagcacaaccacagatctgtggcccccgcacactttccagagaggatttttagggcctcagttgtgggatatgacgacgtttctcttcaaataatctgatcaatcttttattctttaattctagcgccccgccccctttttctccttttccctttttgcctttgtgagatgcccaggcacccacagcaccaggcgttatcagtaccagctcacattcctttccttatttggaaagaggataactttctagctcattacagacaccccttccccttcctctccgctttcttttacgggccaccctatctaaaaaaatcaaatgtttagccaagcgcgattagtttagattgtacgaccgaccccggccaatggggaaagggtagaggggcaggacttgtgtcaggaacaaaggctctgtgcccctttgttcaggtgtgctctcatgacaactggccaaggaggcacccctctgcacgaagtaaaattgctttgctaagaatcctttgttcgagtgttctatttccttaggattttagcattattcctaacaagtatttaaaagggaaagagcaggaagggagggaagagggaaagaaaaatacaggagggtaggtagggagataagtggttacattcttattaggctttgatcgcgctcaccaaatctacatgtcacagtgaaaggagggggtagaggaacagtcagttttgattcagctcagtaaatctacatttagcactcaccaaatctacatgttacagtgaaaggacaggcagaggaacagtcagttttgcattcagctcagtaaatctacatttagtgctcaccaatctacatgttacagtgaaaggagcgggcagaggaacagttacgcattcagctcagtagtctacatttagcactcaccaaatctacatgttacagtgaaaggagcaggcagaggaacgtcagttttgcattcagctcagtaaatctacatttagcgctcaccaactctacatgttaagtgaaaggagcgggcagaggaacactcagttatgcattcagctcagtaaatctacattagtgctcaccaaatctacatgttacagtgaaaggagcgggcagacgaacagtcagttatcattcagctcagtaaatctacatttagcgctcaccaaatctacatgttacagtgaaagggcgggcagaggaacagttatgcattcagctcagtaaatctacatttactgctcaccaaactatatgttacagtgaaagcagcaggcagaggaacagttatgcattcagctcagtacattatgttttgtctcggctggtgagggatggtttctggtgttgtctttgtcccttacctataagataagctgttaatttatattgtcaggtgagggagaccacctggggagatatgtggcttctgtcttgtagcttatctgtttaggaacaaaaggaagttttttgcatattccatgaccaatttccaagcttaacttttccttttcgcttagtgaatttggtcccaagattttatttcctttcacagtataccccatgcccatcaatcccattccccctgcatcctataggtaacccttcttaagcaaatacaaatagataaatccttattttctgtttttttttttaaaactttttttactgttactttctgctgtcctaattatggcacatttttactttctaggttctgtgtttacagagtggtctggctatgtggacagcttctaaattgtcaccacattttggagcaaatgtattatttttacaattaatttacatttaacatgaatcatgatcctaagtgcatcagatgtcttcataacattcgccaaagaagagagggcagcactgctgttctacagtgtggcttcacctggtccacagttaccagaaatagttctttcgttgctgtgatgtcctgggtgggctcattctttagtaatgtactttgtctacagcaacttcctgcaactatgtgaacagatctgaagacacacagtgaggtttggtttcctttgtcctcttaagtctttatggttgttgctttattgtttattggtcccagtgagaactgcagctgacctgatgtcatgatctgtgaagatgtttctattaaagaagaagtaccaggaaatcccatatgccaccgtagacctgcctttctgataccatttactactccatactccagccgccatgcacaatggttgtgtatgaggctccgtgatcattaacaggagtagaagctgggctcagacactctggcacttgcataggtcaagggtgtgttgtgctcttgcaacaaatcccacatagacatccatatgcatattgtcccacctcccctaagcagaaaccagggttaagtacagaatagtcccgggaacattttggttgcccgccttaggtgagcctttctggggctgggattttgacaccatctgctccattgtttctaactgctgtgttctggcgcatcaattgtttcatcacattatcatcacggaaagcttggtctcctcaaaacatgaaccgggtaggccctgtgttccagtgggggcttttggacttgactttgtgtttaggaggacagagtccctctcccctctgtggtgctggggtattagtaaatcagcttgaagagataaggggctggggcctcaacctcccaagaggctgtcactggagaatggtccctgccctcagatcttgggcatttccacagcacactgtccccctcgtccttccaaatactacatacgctcttgtaataggagagctgggaactccacccaaaaccatacaaaaagttatctgtgtatttggacgcctccccagcactcagtcaccgagtttctcctttccaacagcatcactctcatgcagtttaagtgatttattgatgtctcggctaagcttgcgacagtttcagacatttcagccatcaaggtctaagaagccctttccattcccgaggagccctcagccagctccttcttcctcatctcctcactctggccgcgtagcccctcatggcgtccatcttggagcccctttgttcgcgctccacgccccccacttccttcttcgtcagctcctccactttggcgcgtagcccctcatggcgtccatcttggacgcccctttgttcgcgctccacgcccccccttccttcttcgtcagctcctccactttggccgcgtagcccctcatggcgtccatcttgacgcccctttgttcgcgctccacgccccccacttccttcttcgtcagctcctccactttgccgcgtagcccctcatggcgtccatcttgcacgcccctttgttcgcgctccacgcccccacttccttcttcgtcagctcctccactttggccgcgtagcccctcatggcgtccatctggacgccccttttttcgcgctccaagcctcccacttggccctggctctcacgtctgaggcggagggccggggatgtcgcagtcgccctgggtggcctgtttgtacaagccgtagaccacagcttctcctgatcgctcacgggacccttcagctgcttgagggccgcgcagctcgaacccacttggcacatggggtggtggaggcggtccctggtgctagaagctggaggtggagagtggagtggctgttactactcgatctcagggggaggagacaggcacgcgatgtttgtgtttgtcaagcacagattgcaagctcggggtccagcgtaaaccccaccatgtttgggctcaccggcgcattttctggggaggaccagccgtcaaaaagcgtctaggatccggaacgctgcttctggagggggcggcgcggcaggagcgcgttgagggactgtatgtggcgcgagctgggcggtgggagtggaagcctcgcgtggtgcggccgcgctgggtggtgggcgtcccgggggagcgctcggtgggggtgaactgtgtgcggggcacgcccggggttaccgggtgagggtgaatcggggccggggaatcatgagcccgacccgctgggaccccggaagaggggccgggcagggacggtgcggaggggtctagtgagcgacgtccgggtacctgagggctggtgggagggctcgccggaaggcggcgctgtgcgcttggcgcgctcgttcgtgaggactgcgcgtgcgcggcgaggctgtgggcggggccgggcggaggttgtgagcaggcctaagcgcggccgccgtggccctgcgtctcccatcgtgccgtgcgtcccgcgccgcgttcgagttctcggaggggaggggcgttagccccgcgcagccgccggcgtcgccgccatggacctaggtgggtgccgcggctcccggccccgggctgcgtccagcaatgcgccaccagagcggtgctgccccgtcgcgtctctcctgtcgcgcacgctcgcgcgggcccggaccgaaacgtcccccgcgtcggggcgggttaggggtcccggggtggccttggcggggggtggtccgggtcccgccgcgcgttgggccggtcttgccgcctccggccccctgcgcttgaaaacacggagcagacgtgaagttagagccttggaagcgcccggggctcgcgcacgtgctttgggaaacgggctccctccgagcaccccgggcgccccgacggcctcatttcctgaacggcagctgcgttcttgagcaagtgtcttaagctccaagtgtcttacgctcatgacgtttcctcatcgacagagcggggagaatggaagttgtctccccactgagttttgggcgactttgcattgagatcgccgaggtacagtgtccctgtggggttgcgcgggtcacacccgcggtgggggcggctgcgctcctgaggtatcacttttgaacctgcgtgcgtccggattcagaatcttacaggcaaggtctgggagggagcccatagaactagatgctccctgctaaatcttggcacacgctgctaagaccaggaggctgttctggagagctgggggtgaggcaccccgagatgtgtcagcagtagtaggctggggggaaatggctggtccccgcccccagacagcttttcaggagcggaatggcagagctctaagggcttgggcccctcagccgtaattgcttcccagccccaccacattcaggctgggacaccctcagcaatcgtttctgcgcctcagtgtccttatctctagagcaggaatactagtcctcaaaaggtattgtgaatagaagagatcttacctgtgtaccacctagcacagtgtctggcatggagtagtgcttaataaacctaagaagcgggctgtggcaagcactagttaaccatccatgatagataccggagtattttccagctagtaaccgccctgggacttactacttcaaactgtgcgtattaatgcgcctggaaggcaggtgtttagggccaaacatctgctcaactaagccaataatcaataaaattaaatttacagcgtcaggagggactatattttgggaccctgggagagcctctgagccagaaagaagggcggtaacccccagggaggtccccttcgcagcgtaaccctcctgggagtcggtctcagccactgtgagatgagatggattgcctccacaagtgggttacatgtgctgagcccttggcctgctgccgctcccataaatggtgggaggggtaagatggtcctagtctcctggagtcagtgttttctctgctggtgtctggcctgtgaaaatggggaatatggctcttgggggcatgacagactgaggaaggagtagcatctctcactcctgggaaagggggatgactcaggaatgaggaatagggagcagtgtttgcaccctcgttttagtttctgggcaaaggaaacatacctgataaagacctacatcctttgatgtttctgagctgggggaggcaagaatagtgacaagattctggtcttgccaaccatgaaaaggtttggggaaaccaacattactgagcacctaattagactctgtaactggattcttactgtagctctatctcatttatcatcatagcgtcccggggagatggggtcaggagatagcagtgccaacccactagcaagggttgactggtatatatcacatgatccccaaaggcataacatgaagtctgtattatccccaatatgcagaaggaaggcttggagaagcaatctgaccaagatcacatcccttttttttttcggagatggagggggagtctcactgtgttaccccagctagtcttgaactcctggcctcaggatccacctgcctcagccccccaagtagctgggattacaagtgctagccactgaacctgccagaatcacatcatttttaaatggctgaactaggatttaaacccatgtctgattaaaatcccaagatgttttccatggtaagtctgtgtcaatcgttagttccctgaaggaaggctaatctagcacagtattttctgtatctactccctggtttctcccacagagctagggccatagtaccttgtttttgactggaaggagctgtggggtggaccgtttccctgaaagctagaaaatgtttgaagcctgttcccaaggcaagtttataaagagtgaaggcagggcttgtctgatccttctgtgcccattgctctgtggctatgtgattgctctgtgcccattaccctgtggcgtgtgactgctgctgtgcccattaccctgtggctgcgtgattgctgctgtgcccattacctgtggctgtgtgattgctctgtgcccattatcctgtggccgtgtgatcgctctgtgccattaccctgtagccgtgtgattgctgctgtgcccattaccttgtggctgtgtgattgctctgtgcccattatcctgtggctgtgtgattgctctgtgcccattatcctgtggctgtgtattgctctgtgcccattatcctgtagccgtgtgattgcttctgtgcccattaccctgtgctgtgtgattgctgctgtgcccattatcctgtggccgtgtgattgctgctgtgcccattccctgtggccgtgtgattgctctgtgcccattaccctgtggccgtgtgactgctgctgtcccattaccctgtggccgtgtgattgctgctgtgcccattaccctgtggccgtgtgattctctgtgcccattatcctgtggccgtgtgattgctctgtgcccattaccctgtggccgttgattgctctgtgcccattaccctgtggccgtgtgattgctctgtgcccattatcctgtgccgtgtgattgctctgtgcccattatcctgtggccgtgtgattgctctgtgcccattacctgtggccgtgtgattgctctgtgcccattaccctgtggccgtgtgattgctgctgtgccattaccctgtggccgtgtgattgctctgtgcccattatcctgtggccgtgtgattgcctgtgcccattatcctgtggctgtgtgattgctctgtgcccattatcctgtagccgtgtattgcttctgtgcccattaccctgtggctgtgtgattgctgctgtgcccattatcctgtgctgtgtgattgctgctgtgcccattaccctgtggctgtgtgattgctctgtgcccattccctgtggctgtgtgattgctctgtgcccattatcctgtggccgtgtgattgctgctgtcctgttaccctgtggctgtgtgattgctctgtgcccattaccctgtggctatgctccctcatctgtcatgagaagctcagctgtcatgtcctgtggtacatgctcagtggcccctgtatttgtactgtcctcctatttctaaacccctctccccacatcctctgctggcccagccttgctggagggtctcgcctcagcagcccagctttttcttttcacacacttttcctgaaggactcattcaccgtcttggttccggtgatcccctctgggcagatacctctcagaatcacattcccagcttacttccctcctgaacttccacctggcatttccgttgctggaggacatctgaccttgatggccaaagctgaactcatctttcctcacacctgctctgattctcctccattcctgtatgtgatgtcacctggtggcctcccagttcccaggctggagagctcggaagccatctggattcctcggccaagtccttctgactccagctgtgcagtggctcttgtagtcatccttctccccgtccgctgatgtcctttaaaacccttgtcatctcaaaccatgacagcctataacagcagtggccatctggaaacattttcactatactgtcttatttggcttgtctgtggcaggacccttgaacatctgtgaagaaatgactattctgcatggaggcttcttgctggcgagcagctgttccaccctaaggcactggcagaattaacaaagtctgactgggaacgtgtggacggcccatcgtggaggccttaagggagatctcctcggctgcagcacactcccagcctttgcctggaagaagaaagccctgatcatcatctgggccaaggttctgcagccgcacccgtgaccccgtccgacacagagacacggtggcaggaagacctgttcttctcggtgggcaaatgatccccaccatcaaccacaccatcctcttcgagctgctcaaatccctggaagcttcggactctttatccagctcctgatggccctgcccaccaccatctgccatgcagaactagacgctttctggaacatgtgaccgttgacacttctgccgaagacgtggccttcttcctggagtctggtgggaggtgatgaagcacaagggtcacccgcaggaccccctgctctcccagttagtgcaatggcccataagtacctgcctgccttagatgagttcccccatcctccaaagagcttaggtcagacccagacgcgtgccccaccatgcccctgttggccatgctgctccgcggctgacacagatccagagtcggatcctgggcccggggaggaagtgctgtgcgctggccaactggctgacatgctgactgtgtttgcgctgacagaggacgacccccaggaggtgtctgcaccgtgtatctggacaaactggccacggtgatctctgtgtggaactcggacacccagaaccctaccaccagcaggcgctggcagagaaggtgaaggaggcagaacgggatgtcagcctacctcgctggccaaactccccagtgagaccattttcgtgggctgcgagttcctgcaccactgctgcgggagtggggggaggagttgcaggccgtgctccgcagcagccaggggacaagtacgacagctaccggctgtgcgacagtctgacttccttcagccagaacgcgacgctctactgaaccgcaccagcctgtccaaggaggacaggcaggtggtctctgagctggcggagtggtcagggacttcctgaggaaaacgagcacggtgctgaagaacagggccttggaggatatacagcttccattgccatggccgtcatccagcagaagatggaccgccatatggaagtgtgtacatttttgcctctgagaagaagtgggccttctcggacgagtgggtagcctgcctgggagtaacagggccctcttccgagagccagacttggtgttgaggctgctggaaacagtgatgacgtcagcacagctgacagagccatccctgagtctcagatccggcaggtgatccacctatcctggaatgttacgcagacctctccctgccaggtaaaaataaagtccttgcaggtatctgcgttcctgggggcgaaagggcctctctgaaaagttgctggcttatgtggagggtttcaggaagacctcaatacaacttttaaccagctcactcagagtgcctccgaacagggcttgcaaaagctgtggcctccgtggcccgcctggtcatagtgcacccggaagtcacggtgaaaaaatgtgcagcctggctgtggtcaatctcggcacccacaagttcctgggccagattctactgccttccctgcccttaggtttgtggaagagcagggtcccaattcatctgccactttatggtgtcatgcctcaaagaaaccgtctggatgaagttctctacacccaaggaagaaaacaatttttagagctcctgaactgcctgatgagtcccgtgaaaccccaagggattccagtgctgctcttcttgagccagacgaggtgctgaaggaatttgtcctgcctttcttgaggttgatgttgaagaggtagacctcagtctgaggatcttcatccagactctagaggcaaacgctgccgagaggaatactggctccagacctgctccccgtttccactcctcttcagcttgtgcagctcttggaccgcttcagcaaatactggcagcttcccaaggagaagcggtgcctctcttggataggaaggatctagcgatccatatcctggagctcctgtgtgagattgtatcagcaatgctgagaccttctccccggatgtctggatcaagtccctgtcctggctccaccgcaattagaacagctagactg

SEQ ID NO: 5015 - DNA, 16139 bp, Homo sapiens
cctgggcctcaaactgcaatgcacctttcagtgcaataggagctatccaatctccagcccgtccatccgcccactcgagcccacctgtttgcggaccacagagcggcagcacatccctcacggggctgtcaggcaaggtcaacgcgctagagtgcaagagcctttgctttgcggattccgcagcgccgggtgtgggcgcaggtggggatagagtgctgggttttgaaagagtgaccgcaaagctgagggtgcagagcaagacacagatctgggaagagcagagaaaaaacgctccgcttctgaacccctcccacctcgcatcacctgacaagtctctcaaggtctggtgtcgggaaccccacctcttcaaagccccgcccttcgaaacaccagaaagtaacccccctgcccggcctgctttccccctaccccctgccaagctgcagttttttttttgttttttttttttaacgggtgagggctagaaggagcggtagagattgattcattctagccaaaccacctctcttacaaaaaaaggaaactgaaccccgattggcgaaatgtcttgctcaagtccataaagcgagccaccggctgatctggacccttagaatctacccacccttctccacctcccctccccagcacctgttgccatggtgatgagaacaggctcctgctgaggctctggctgtggtcgcaagagctggagaggctgaggactgggctggatatgctgaccatcagccaagccccatccagggccgcgggcagttctgcgcgggggtcaggccgctggcccatttcgcagaggcggggagagcacgaagcggctcatctcgcagtgtggtgcgggggcgccccggggataccgcctgaaggagcctggagggcgcccgcggggtctgagtgtagagaaggaagttgcagctgtagagtcacgccgggaaaggggctggaagggcagcgttcggggaacttcaaatgcacagactacccctagtgagactcactttacaaaggggaagctgaggcctgaggtcactgccggatctaaagggagggggtttcggtggaggcgacagaggtaggggggcggcgagtccctagagactcacgtgtacactgagatagagctcagggtcgaggtccggccggggcggcggttcccccggtcctggcgcaacagcagtgcaccgggtctcttggccaggccctttccgctcgcatcctccagaaccaacactcgatcaccgcgggtcctgctgagacggcggtcgccaggcctggcgtatgggacgcgagtgaggagcggtttgtatgtctggtgacctgccccactcccaccctggcacggctccagtggggccacctccctccgcttccctctagttcttgggcgatgagtcgcgggttcgctcacccaaagccacagcgaggagcagagacagggacttcatggcgctgcgacccctcagccatgaagcctcctcttcctcctttcactttcactttcctccaaagggcggcagaggggcggtggaaatccccgctctggttaggtgaaggtgcctgggggaccggtgtttcccactggccaggcagggacccgggtagatcctctccagttctcaccaggacaccccagcttaccgcgccctcctggactacccagcagccccgagttcgagccctccccaaccccaggcctcccccgccccccaactcctgtgtgtgctctccaacatccacttgcccgaaaaccatactccggcttccccctatctgtgccgcgtccccagcaaacacacgggttatcgggaagcaagtaaatgaccaataaatattttaatcactgttaaaaaaaataaaaaccttgtactccacgacttactccctccttgtctccacccactcctccatgagaaccgagttgggaatttcacgggaagtcgggggtggcggggagagacagggtagaaataaagagcgcatccttgagaggggtaggttctaggacaagggtggggctcaaaggccttgtctccacgacaacacaaaccagacttcaggcacagactacaaccacctgacccctgaccctgtgactgcaggatgttcacacgccccctctccctccctccatgtgcaatctactctgtggagcaggggcttcagtgacccatcagagggaaaggaagggtttagttctggaaataccttgggggggaggggttgatagtagaatgggcgggcgatggtgaaactgtggttccccttccagaatatatacaagtcacagagataaaggaagacagtaagtgtggtgggagatcacccgggggccacagcgccctgcatcgtgctccttattccctttcccgaaagctaccccaccccagtagcctgccccttcgtttgctcctccacctccaccgaagcccatctccaccttgtggactctgggtggggaccgacacgtctgctggacgggggcgtggccgcactcgcttcgtcgccgctgcccccgcccatccgggagactctctcttggacggcaaggatggccccgtgggagtcccaggcccaggtaggccccgaccccgcccaggcggtgccggcgctcacagtgtcctcggtggcgcatgaagcgtctcgccacatgaacttcttggcgcagactccgcactcgtagggcttgagacctgtgtcgtcttcatgtgctcagtcagatggtgcttcatcttgaactttttgttgcacacggggcgtcaaacggccgcagattgaggtgcatgttcacgtgccggtcccgcatgctcttgtggggaaggccttcccacaatggcacagaaagatcttattcccgtccccactgccagtccctcagggaccccaccaacgctacccggcacacccaggctccccaccgacgtgccccccacggcactgccccgtgttctgcttggttccctggtggttggccaggagcctgtgaggatgaggtgaagacgacgacgggaagaccaggatctggttgccctgcatgtccaagggaaggagcgtcgaggagggtgggagggggcataggaagagggagttggcccccctgagtcatcaagactgccacaggacccccaccctcatatgggccaaagtcattggaggactcacagaagttgactgctcctcccccttgtctgggggctcactcagggtacggacatcacttatgctgagggagcctcaggccctccccccactggaaccctggagctaccccctagttcttcatcttcatatcctcacaggtcaacaccagatcttcctcctcctcttcctcctccagatctgggtcttgggaaccaggggtgttggcgctgggcaattaccacctcgcttcacgtatacccagtgttctgtggcatgatgctagggggtgtgtaggtgggtctccggagcccagccccaggaaccatgcccccctcccatccccaccatcatcgcacagctcatctgcctccagcagcagctttcagatgtggcccctccactgccaacgacaggggctgggaatacagggccacctcctcgacctccccactgcccactgcagaagctgcaaatgcctcttgggaggaagatgagaaatcagggactccctggggctgaagtagttgctgctgctgggagattgattctcactggcccggcggaggcatgggagcgcgcagagcccatggtagcaggggccacagtgcccccactcccggtggcaccccagcaccagggacagtgacagaggtggctgcagcagtagtgatggtggtggagctgaggcccggccttctcggagtagttcagtgcacttgtccacaatgtgccacatttgagcacagaccccactgtaaggaagttgacaatgtcagcagcagccatgctgaggcggcagtgtaagcggaggctaggacagtctcaaaggcgcctgggtccatgacactgggcagcggatggaggtcatgcctttgagtaggacctgatcatggaagtaaggggaggaggcagccagacagcccgatgagcccggaactcccggccctgcactctgatagatacatcgcagagctgccctgcagacgctgctgattgagggactccaagagggcactggtcacctcagggaaggcacatgtaccactgcagctgctggcaggggtagtgggggcggagccagcgacagcggcagggaagtgctgccccactgggagacagaggagatggctccatgttgtggagggaggggaacccccccagccacaggaacaaagaaaggaggagggcggccgggggggtctctgggaagaaaagagaaaagaataatgataacatctcataacgacacagcccgttacaactcaaaaaatgttcacgctcattatctgtgtaactccccacaacagtgaggtaggtattcctctcaacccatttgacagatgaggaaactaaagctcagaaagattaagagattatccaaggtcaccagcaagtggcagcgccagcaaacacaggtatctgacaaatcttgtgccctttccttggggttagagaaataaggtgctcttaggggctggagtggcttccttcggaattataccctattccgacttacctgagagcctgacattccaaaatctacctttttggtgttttgcacccatttttgggagggggcagggcagctctgctactgaaaaccaacgcttgctccatctcccccaggctatgccccccaagctctctcgccgaccacgccccctttcgccccagcttctctaccccgcccctttccaggcccaccccccccgtgccccgcccactatcgggcctttcgacccgccccttgtctacctccgcccacaacggaccccgcccccccccgctccgccccaagcgtacctcggcctcttctcccacccggaaggcgccccccaacctcgcgcgtccccgcttacgggccgcgcgcccccgggccccccccgcccctcactcggcggccagagcagcaacctggcccctcccgccgccatcttgcgccgactccctccgccctccgcctccgctccgcctccccccctccgcctttaaaggcacagccgggcaccccgcccgtgccgctgggcaatactcggcgactcggccactttgcctttaaagaaacatcgccacattccaccttaaaagatcaggtccctcctccgctgggagctcaggacttggttcggccgaagcatttattcccctttaaagtataagcctgccttttcccattggcgatgggtccaggtatcgttccccaggctccgccttgagctgtgaccattagctggttggtgggatctaatcgccctcttcctagctccttacatcccactgaagccccgccccctttctccgggcctggattggctaaataaccttgagtcgcccctcattggctttctcactcctactgcacgaagtgaaaaagtaaagtgcgttaaggcgctgaagcacttaaaaaaaaaaaaaagtactgcctgaacaacgtggcgaaaccccgtcttacaaaaaatacaaacaacaaaaacaaaaattagccaggcatggtggcacgcgcctgtatcccggctactcgggaggctgaggcattatcgcttgagactgggaggtccaggctgcaggagctgtgatctcaccactgcaccctggcctgggcgacacagcgagacaaaaaaaaaaaaaaaaaaaaaaggccaggctagaaaggacagagcgggactaccccggggatactgggctaccctgagcaaggggacagctaatgccaatctgtaacagtagaaggacaagaaaaagacgtgatacagtaagaaaagaactttattgtttattaatgtttctgtgtaaaacttaagctttttttttttttaaagaaacaccaccaaaaggggattagcttagtccatcccttcctcatcatctgcttcccaccttcctccaaatgttatcccagaacattctggaggcagggagaagggaggcagctaatcagagtctgagagcacgatgatctcttctggatcgcattgtgtggcacacttgtctgcagggaagtgagagacaaagagtcaaagagatctggagtacaggagaaagaaacaggaggatttagaggataaaatgggtgggaaaaaggaagagacaggatgtggacgtggaatattcagacagagcagctgaaacagccaatgaaagagaacaaattgtcagagaaacacgccctccccttcttaccttgcaagtaccaggccgaggaggctgtgaatgggggtttgggacagccgggctggagaagggatgcagagggagctggtcaccaggccatggctggagagtccaccctcgtggaggaatcagcaactggggccaaggaagccaagggggaagggggctgggcagggtacatatctttttcccattcttctcatgcactgacctttgcctttcacatagctagaaacagaaacataaatatgtggaggggtacgggaagactgaggctggagggggcagtccagtctctcccagcagactcagttccccagtattgctctccgaaagtccctgcaatccctccttggcttccctcttcctcctcctcttgttattacctgtttcctaatgccctgatcctgtttgcttcttctccttccgagattttttgcaggggggaccagaatctcccagttgtgaggagagacgcctccattgaaggaagtagaagagaccatgcctgctccatctctaagacagtggtgaagggctcctctgattgcttcctggaagaggaaatgtccgtctcacagaggaaggggtatccaggggcaaagcttcaatctctagctcaaagagctgagacaagggctttcttcctccagggtcagctcctcaggctgttctccattgctttcagcatctagctggagggggccaggggttcttctgacagtaacgatggtgacactatgcgtcctttgtttgctgctcccctgaagatctgctgatctgtttgccaggttccaggttcttttcattgggatctgtagtgaggacatggggctcttgtctccatctttacctggaaaagaagaaaagggagagggtagcctgagaatgagggggaaaaaatactgctgagaggacactaggaggaggagggaaaggtttcaaacaggtggctcatgcctaacaaaacagaaatgacaggtgaggagatgttcccttgacatacctgctgctgcttcttcctcttcgtcctcctcttcatcatcctctgaccctcctgcatctgttccagatcctcctcctcttcagaatctgtggcctcctcctttcttcttcctcctcctcctcctcttcctcatcactctcctcatcgtcttcgtcatctgctcagctctggaggcagaagggcacccctgggatgccattccactagggccctgggagaaaagaagtttctctaaggaatcccttgccccagagggtttggttcttgctttccttctctgctcccccatcagtcaacctggactccctggtggccagtgcaggggaaggacaatgtcctctgaaggctgtaccccatccacacctcaccagaatccaaggaggcttcgggggtgtcgcagagtgggaagaggtgccttggagccgagctcttctcttttttctctcgccctcctccttttgtcttgcaacattgcatatttggagatgacctcatccagccgactcatggccaactccggttttcccgaaggcgccgggccaacacaggatctgatagtgcagggtcaacgccacgtgggaagacataaagtcagagcactcagcccttgaagggactagaagagtaaaaacctagaaaggactagagagatgccccatccgcctcatacctgacatataagggtcactgaaggcatcccaccaaccccctacctggcctatagtcatctgtgaggtggcagccaaagtttagatgagatcgaggtgacgtcgctcctgtaacctgatgcccacatctcggaaggcatctgagccatgagctggagctgctgtcgggggaggccaaggctgtgtcgggcagctgcctttctacagcccgaagcacatccccatagtcagggaaggtatcaggccctggcttgttgatagccgctcaatgcgcctgttaacctctgggtagcgggtgccacggtaggggatgcgctgtctatgacacggccggtcagtgaagagcagtctttcagctcacatagtcgcccaaagagcggatcagcttacgcttcaaccgtgcctcctgcaggtatgcggagtctgggtcatccaatctgagagatccaactccttttcctgcagccgccggatctctgccacatagagcgccagagctgctccaaacgctggatctgccgccgggaaccacgggtccttggagactgagaggcgtgttttcagcatttgtggggtccaaggagaggtgtgtgggagggttattcccagagggtcattggaggtggtggcggcaggggccaagttcagcttctttttggctgagtgggccttagaacagtgcagagctcattgatgtagacatagagcttggctggccggctccgggcccggacaggaccctagagaggatgttgcagaactccgccgaggccaaaaacagagagtgggccgttgctgccggttatagaggaatgggaccacctcagggtggtctgctgtctgcatcttcaaagttcaaggaactagaaggttcaggggaagaaggaaggggaagagagacaagggaggggttgagagaaaggggaggtggggttagtgggaaagaaaggacaggagaaccagtcagcatccccctccctggggtacaacaatcttccccgctaaagctcacctcttcgaacagctctcattctccagcttgtagcatttcttgccgcccgaactactgcttcctctggccccataggctcagaggagctaggggcttctgccccaggtgaggccgcattggggagtgggtggggggccctggctgagcagctgcttcatcttcgtcatcatcatccagcacgatgatgctgtagcggtggccataggggatcaaatcccccggagggaggaagtggtggggatttcagaatcctgctggaaggggatggggcctcagaatgagcccctccagcatagccccatcccttcactcacacattttctgaactccttgggtttcagtaacatccagccctgaccaacactgtctcaccacctgatttcaataaccattagttctatatgctttttggggcccttcaagtggttggggggggggcaaaccacccccacaccttaagttgccaccttctgctccacccctcactcgatttccggtctttctgttgcatttcccccctatttcttagagttggcaagttgattttcctcccacactgcaccccaaatcgtcctgacacccccttgcacagacaacacactccgtgggcgccacctcatgtgtttgccccctctgctctcaaacaagtcaaccccacacccacctatcctgaatgatcaccccaactcctagactctctgaggtgaaagaggttccctcccacagtccgttctcttttctcctccttgaattatctccatatttcaccctccgatgagtccctcaaactggggctttaggttgaagatattttacccaagtcccctccctttcaccccacctaattttccccattctctcggtgacccgtaactgatcaaaagtccccccgcaccgcgtacgctctcgcgattcctcttagatcccaaccgtgggtccggccggtccgctagatgcgttcccgccaaatccccctcccccagttcagcccccggccgctccactccctttcagggaaggaaggtaccacagctttcccctcagactcagcgcccagctctccccaatacctctcctctatatccccgcccccgcctctgatccccgcaccgtccggcccccacctcagaaaccgctctcgaggcgaccctcgccgcaattctcagaacctcgcatggttccctccgccttcctcccactcccaccgcaggccccactacggaccggaagtcacagagtttccgccttcatgcactaagcgccgccatattgtcgtacggaacacaggcttcctgtggccggaggtgacagtggcccgccccgcgaacacctccagtgcggcccacatagtcagcggtctcttccaggtcgagtttgtctccccgaacccaggcgtcccaaagcagctgggggccgccattttgccgtacgcactggctacgcccggactccggtgcgcagccagtggagctcttttcacccggtgctttacgactccgccaatcagaaacttcctgcctggggcccaaccgccggagagtagcgcgtgggaggaccgagcctcgtttccaaggaggggcaggggaaccgaacagggtggattaggattgggctttccaaagctgtgcagagtttcagggaagggcagaagtctcttaaaagggaataaaaccttttctttcagttgggctattggcaagctatctggccctgctttcctgtccccaggttcccatttccacggcttattcggctgacccagccccttcccctgcaagggcggccgctccttgccgctgtccagcagctgtttctactgccaggtgctgcgtcccgcgatcgtataacacatgcgtacaaatgagcacaacgcgccataaaagtgttattgttattactattttgctgatttgcttttcaagcttcaccacagaactaatgaccagccagaccgttgggactgaatggttcttctccagagggggtcctcgaagggccgtctgtgctgaccaggtggccggctttgtcgtgggaggcctagggtctgcggatgggcgatgatggggtggggcttggagggagtttgtgcaaattgccgctgcgagggctgctgtgaggcgaaatgaggctcataaaatctttgggtctcctcctcctcctcttcggggagaggggaaaaaagaatgaaggatgaagaacagatttgatacccacctcgttgtgtttagggaggctggagggactcgtggaggcaagctgggtccagaggtgagcttatgaggaaaccagaaagattaacagggtcccaatcgctagattcccatttccacaagtggtgggcatcttgccacttaactagggtcacagagcttatagatccctaacgctgagtcctagaatcgcaaacacccgtccgttgaacaatcccacatccttctctccagtcgtcaaagtctacagctttcaaaatggggaacataaaaactctccgcaggactgggacttggaagatgtaagggatttaatttcaagaacctcaactttcccaaaatggtcttcctaaggaaacacctgcagtacaggttctcattcttcacttctccttttacatagagtcaccctcttaagaaaaaaaaaaaaaagaatagttctcttttttcccctccccctcaaaagtatagttctcaaccatgaaatctcctgggggtaatcttacctgtttaaaataagggaaatgtaccctgtttctttcaccaaggcaccatgaataccaccttttcttttttttttttttttttcctttcttttgtcttttttttttttaaatgcagggtcggccgggcgcgtggttcacgcctgtaatcccagcactttgggggtccgaggtgggcgtatcatggggtcagagatcgagaccatcctggccaacatggtgaaaccccgtctctactaaaaatacaaaaaattagctgggcgtggtggcaggcgcctgtagctccagctactcaggaggctgaggcagggaaccgctcgaatccgggaggcggaggttgcagtaagccgagatcgcgtcattgcactcagcctgggcgacagagcgagattatctcaaaaaaaaaaaaaaaaaaaaaaaaaaaaaggaaaaaaaaagggtcttgttctatcacccaggctggaatgcggtggtacggtcatagctcctgtaacctcaaattcctgggctcaagccatcctcccacctcaagtagctaggactacagcgcacaccacctcacctggctaatttttttaaaaaaagttttttgtggaggctgggcgggtggctcatgcctgtaatcccagaactttgggaggccgaggcgggcggatcacctgagtcggaagtttgagaccagcctggccaacatggtgaaaccccgtctctactaaaaacacaaaattatctgggcttggtggcacgcgcctgtagtcccagctactcgggaggctgaggcagagaatcgcttgaacccgggaggcggaggtcgcagtgagctgagatcagccactgcactcagcctggcgacagagcaagactctgtctcaaaaaaaaaaaaaaaaaaggttttttatacgacagggtcttactgtgttgcccagatggatcttgagctccttgcctcaagcaatcttccacctcagcgtctcaaagtgctgggattatgggcgtgaaccgccactcccagactacttcttattaaatatttctttttaacagttataaaaatgtttacgatcggccaggcacggtgctcacgcctgtaatcccagcactttgggaggccgaggcaggaggatcacgagggcaggaatcgagaccaccctggctaacacggtgaaaccctgtctctactaaaaataccaaaaaaaaaaaaaaaaaaattagctgggcgtggtggtgggcgccttgtagacccagctactccggggctgaggcaggagaatggcgtgaacccgggaggcggagcttgcagtgagccgagatcggccactgccctccagcctgggcgacagagcgagactccgtcttaaaaaaaaaaaaaaaatgtacgatcacatgtttataagaacattctgttcttataataattgtaacagtaactccccagaataatttttaacaactagagtcttacaatcacaagaaagatatttttcatctcattaatatacatgtatatgcaggaagatgtaaaagattggtcaataaaggactttcaagttaaaagcataaagtttgtggggaagtggagtagtagtaggagctcaaggaaaaaagagggatgaaagaaaaaaggaatgattcccaactggtaagaactaatttatacttttttttttttttgagatggagtcttgctctgtcgcccaggctggagttcaatggcacaatctctgctactgcaacctcccactcccgggtttaagcgattctcctgcctcaacctcctgagcagctggattacaggcacacaacaccatgcccagctaattttttgtattttttgtatttttttttttagtggatatgggtttttggcatgttggccaggctggtctcaaactcctgacctcgtatccacccaactcagcctcccaaagtgctgggattacaggcgtgaagcaccgtgcccggcatcactatgatatttcaattccactggacaataaatggtgatctaattgttttattttaaatgtggggccaggcatggtgactcatgcctgtaatcctaccactttgggaggccgagcgggcagatcacttgaggtcaggagttcgagaccagcctgaccaacatgaggaaacctctctctactagagatacaaaaaatagccaggcgtggtcgtgggcgcctgtaatcccagcttttgggagctgaggcaggggaatcccttgaatttgggaggcaaaagttgcagtgagccagatcacgccactgcactccagcctgggcgatagagcaagactctgtctcaaaaaataaaaaataggccgggcgtggtggctcaaacctgtaatcccagcactttgggaggccgaggcagcagatcacctgaggtcaggagttcgagaccagcctgcccaacatgatgaaaccccgtcctactaaaattacaaaaaaattagctgggtgtagtggcgggcgcctgtagtcccagctattgggaggctgaggcaggagaatcgcttgaacccgggaggcagaggttgccggaagccagatcgcaccactacactccagcatgggcaacacagagagactgtgtctcaaaaaaataataaataggccaggtgcagtggctcatgctgtaattccagcactttgggaggccgaggcagcagatcacgaagtctaggagttcgagaccagcctggccaatatggtgacacccccgtcctactaaaaatacaaaaattagctgggcgtggtggctcgcgcctttagtcccagctactgggaagctgaggcagaagaatcgcttgaacccaggaggcggagatttcagtgagccaagtggtgccactgcactccagcctgggtgacagagcaagactctgtctcaaaaaataaataataaaataaaatgtggccagctgtggctcaccgcctataatcctagcactttgggaagtgaggtgggtggattgcttgatctcaggattacagaccagcctaggcaacatagtgagactcatctcaataaatcaataaataggctgggcgcagtggctcatgcctgtaatcccagcatttgggaggctgaggtgggcggatcacttgaggtcaggagttccagaccagccttgccacatgatgaaaccttgtctctactaaaaatacaaaaattagctgggcacggtggcacacactgtagtcccagctatttgggggcctgaggcaggagaatcgctagaatctgggaagtggggcaggctgcagtgagcagagatcactgccactgcactccagcctgggcaacaggagacctgtcacaaaaaaaaaaaaaaaaaaagagttcaagaccagcgtggccaacatggtgaaaccccatctctactaaaaatataaaaattaggggtgctggtgcacacctgtggtcccagcactcaggaggctgtggcaggagaattgcttgaaccccagaggcagaggttgcagtgagcgagattgcaccactgcactgcagcctgggcgacagagcaagactccatctcaaaaaaaaataaaaattaaaaaataaataaaatgtgaatattttcaatatgccagaattacatccttaaacaatttttatttatttatttttatttttatttatttatttatttatttttggaagggtctcgctctgtcacccaggccggagtgcaatggtgcgatctcggctcactgcaactgctcccgggttcaagcaattctcctgcctcagcctctgagtagctgaggcagagaatcagggcccaccaactttcccggctaatttttgtatttttagtagacatggggtttcaccatattgccagactggtcttgaactcctgactttaggtgatccccctgccttggcctcccaaattctgggattacaggcatgagccactgtgcccggccacaattttaatttatgatgaaaattttagatacctacttaaagatatatgaaggagtatatacttcttcaaaattatttccctagtataggtgcagaatttaagactgctgccctggccgggcgcagtggctcacacctgtatcccagcgctttgggaggccaaggcaggcagatacctgaggtcggagttggagacctgctgactaacatggagaaaccttgtctctactaaaaatacaaaattagcagggggcggtgggcatgcctgtaatcccagctactcaggaggctgaggcaggagaatcccttgaaccctggggcagaggttgcagtgagccaagattgtgccattgcactccagcctaggtaacaagagcaaactccatctcaaaaaaaaaaaaaaaaaaaaaaagactgctgccctaagctatccaagatctcctccatagcccccaacactcccatttc

SEQ ID NO: 5016 - DNA, 26256 bp, Homo sapiens
acgatggctgggttaggggggcaataggcagagctcaggacatgacaccaatcccccaccctggccagaaccctggagtcccaacctcacccgccagtcacctctgagcctctgtcagggccggagcccctgtagccacctctggatatcatggtcaggttggaggttatagccacgcattcattctggagccgtcgcaactcagaaaggactgcaaactcctgggaaggagccctaaactgcaggagccaaaactcagggacccctgacttttccccctccccttcctggaacaggatagggaagtccagcatccagcccagacactccgctcaccttcctccgcttgtcaaattgatgtatccattctgcgaggaaaatggggatggggtgaaagttccaaccctaccttcggccacagagagagaatatcccctctcttaaacacacacagccacatccaactcacaacacttccctccagcctctctgactcttcgatccctccctgccttcctcctcaatctatcaggcctaagcactccacttgaccctttaaattgaatttctcaggtagacaacgagtctgcttgcagatgagaggactggatagtatccaattcgacaggattccttatccagagaggataggaacttgtccaaggtctcagtatttgtttatttaacaaactctagcaatagagcagggcccatcacaaaacctagatgtgcttacgtttcaggcacgttctaagcacttgacaaatcaaattcatttaacccttataacagatcaatgtagatgctatttctagtttcccatttaagatcactgaggcgacttggcacagaaacagatctggctctgtcccacactcagctattgtgccttacagccccttgcaaggggcgggggggtctgtccgaccctgcagcccacttgtacatcattgcaatgacacacacacacaccactgacctccaactcatccttggaggctgctccagcatcacaaggtccttcaggaaggtgccaaggtatgggaccacaccctgaagtcagggtcagggtcagaagtgcctgccattgacgtgagggccctccatccctccgcacttgcctcctcattgcctcagagaacagatttcattctcctcacccctctgtgcctcccttaccatccttcaggctgctcccccaaaacatactcctcaccccttcataatcaccacccccaccccaccaccccgctagtcactcaccccaccccgggagccagacctcggggccttcttgggtgtggctccagaggagactgcagcttcacctcctggtggtgacaaaataaaagagacagggggagcagtagggaacaaggagaggtgggaatgccacaaaccaggctctcacctgcagagcagctcccgactctgggaataattatcctcctcggagaaaatctggcagaggctggaaagactctgaggctgtccctggggaagggagaaaagtggccctgaggacaggcctggcctgtcaccccctcttccccgccttctgaggaacccccaccccagtccaatgcctcagccccgcacctggttgcttccccccaggctgcccgaagcctgtggatggggctggactgcaggctgacaccacggcataaactgaagagaagtttcggagcagccggcactcctgtgggggcaaagaagagagctaaggctatgggaggcctctccattccatggccacaaaccgtagggaatcttctctctcacctctgccacgcggatccacttctccaggagccgggccctctgtggggacggagtggccgtatggtcacctccccaggtccctctccagtggaagtagcccccagacagaactaaccactgcccctgccaccttgttaaactgtgtgacagtagctcggacagtgggcagaggtgagaatgtcctggccggtctctgtgaccccacaggcctcccaggcactagaggggatcaaattgagaaaaagttcctgcagggtagaggtcagaggttaaagttcatgtcaagtgaggtcagccttccaatatcagggatctgaggatctcaggtggccaaggaacagaggggcacagggtttgaagggtaacgaccaaagggaaaaggggagaatcaaaatggtggtggaggaggctaggagctggatcaggaaggggtggaagcaaggaaaggatctggagtaaggagaggttagtaaggggtcagggggcataggggccagaggtcagggtctcaccgcactagcagggtcagctgttcggccaagtggtcagcgaggaacaccaggacatccgtggggcagcagggggatcgccggggagggccaggggcttaggaaggtcgggggcctgggggtcccccgggaccggagattgcggatgaggtcagcgctgccccccccaacacccttccctgctcataccctgtctgaagtaagaagctctcaagccggtcaagctgacccttggcctcagagcaaaatcctcagggtgagaggccagccaggttgacagtacagagatggctaccctgggaaagggaatcagccaagggtgagaggtaaagctgcagcctgggcagaggggactgtgagataagaaccaggggtcactcactctgttgtcctctctagttcgtcggtaggatgagattcagggcttccagcctgagggggagaagaggatctatctgtccatttttcccaaaccctcatggctttgactattttggtgggatgttgcggctttaggaaatccgggcagatactccacaccctgcgtcccttatgactctgacctgtcagccataagccctagcaaggcaggcgtggggtgaaggcccggtgggtagccaggaaggctgacatgaagctcacatcagtccctgatgccgggtatccagtaggtgtctgaccagggcctccagagtgccagctcggagccgtcgggggaacgtgggggaggcatagggacctggagaacacagagagatgatcgctaaccctttccccactctgcacctagatttctgaggacaatcccagacccaggagatgttccagactcattttctgatattcagagagggcaagagtcttggcctatgtcacacagcagagtccaggatccagaactccaacctagcactctggccagaaagtcagccagaggaaggaaaactgggatgaagagtcagaggtgagaagctaaagtcatgatctcaccaagggatcaagaggtcgatttggcggcttgtgacggtaaacacggcaccatcctcctcctcatcccagacggacacagggcctggaggagcaaggaaggggaagtcagacagttccacaccaccccccattgccctcgccttcaccccaggccctgctcctccctctgtacccctcacctgtggtggcagggcatataccagcgagtgcgaggaagggttgggggagctggtgaccccaggtctcccccactgggcccagacagccccaccccagccgcctcagggccccggtggagtcgaaggggctgcagtgaggcgtggatggagtacaggaattctgatcctggagacccccaaagccccttctccccaagctgaacccacacacgacagagaagcagggtacaaagggcaggagagggaagcgagagcagcaagccagaggcagcgactaggggtagctgaaacctcagtccaggcactgccgcatccccgcccctcccggccaaggactataccagcccagagaattagtctttttcaggaccctttcaccctggtccctcgggtagcgcctccactatctcagccctaagggacccccgaagtagcagctccaatcccagtacaggaaggaaaaggggaagtgggatgatagggggttggggcggtagactcagagagtcacgtggccccagcccctcccccgaccgatcccgaaaaaccgccctgccagtcaacctgccctcacctaggatctggacctaggagtttagggcctcgggccccaaatccaaattctggcccctcctgaggcccgaaatcctgctcctggccaccaccataatccctaatgaaaacagatgaccactctctacccaccctaggatctttcctccaggtccagaaccgtggcttcccggcctctacccaggaccggggcggggcgggggggcggggggagggggagagagggaaggaggggtcacgaaatctgagggttccctccccaatcccagagcagaggagctggttactgtggaaacaaacccctccccgccaaacaaaaacaaggagggaacagggaccaagacacgactgctcagagaggtaggcacactcaggcaggcagaggtggaggccaaagacccgcagggacaggacagccagccagaagttccaggcaggaacagggcagttcctgcgggcaggtcctgagtcacactgacagagaaccacggagacgccaggactcccgcagcagagaaacgggccgacacccagggaggcgcgagaataactgaggcaaggaggagagatgtagggacccagagacaagagaaaagtggagacttcagaaatacatacgccccctcctcccaccacccgcgtctcacctcttcttcttcctcctcctcttcctcctgccccccgccacgaccaggccacctgggcccccaccctcttcggggtcccggcttcggaagctgctcgtacgactcccccgggggggctcgtgtccaaaagcagccgcaggggccgcgggagcatgccgagtgaaggaatcagcggggtcgggccatgggggcgcctggggagagacggggtgggtgggggtggagagtcaggcaggcgcgggggaaccgggcagggaagggacgtgggtgggttcaagaagaccggaagggagttctgcaggaaggttgggggagggggcaacagaagggtgaataggggggcccttggtgctgttggggaaggaggaggtcacgagtacggggacgcgcaggtgctcaggctctgacctgctcgggaggggtgggggcagcgtgggtcctgagccgctgtgccgtcggtctccggccccggaccgagtcccctccccggcttttccgtacccccttgacccccccgccgggctcctgggccctcccgccctttccgctcccccccgcgtccgcccgcccgagagcaggagccaaaaggggaaggaagtgaggacaggagccagggccgcggactagggagcgctggacgctcagggaccaggacccaggcgcccgagtccccagctccactgtccccgcctctacactcggggattctggagaccacgtcgacccgcaatgaactggaataaagttccagtctccagcccctgggggaaggcaggagcagaatttgacattcccttccccaacataacacggctaaaactcccgcgggaagcgtttcaggcggagagagagccggtcactcctccccacgggattaccctccctaccacaacccacgaatgtagctgaccgaaatcccggcgggttttccgaagggccctcgattcccgccccctcggcagggggcggggcaggaagcagcacatccggttccagattcggctctcagaggcttccggcgccgagaccgagatccccgtggctcggtgtatcctcgctggtggagtaccctctgcttgagcgcatctcatgcgccagtgtggcgcccgccccgaacggtgtcgacggggcgttctctgagcggttcagggtcactggagggaccagaggtgattggaatattcattgagcttggaaaggggttggaatgagagaacgtttggaagcactggaatacagctttattcctacacgattagacccgttaccccgtgggctggccgaccgtcctgactcggagatccctgagctgcgccgccgcttccttcgtcaacaccagcagctacttgatgagcgccctccagtgggccttaggtccctatgccggcgcggggtacagcagtggacagacaggccagtccctgtcctcgaggagcccatgatccgcggggagcaggcatttaacgacgactcacacgatcacttaaatacaactgtggtgaaccgcacaaggggacgcgcggcggtctgcggggaatgacgaggccgacctcgtctgcgacccagggaggcaagggtggaccaggcaaagggaacagaggactgggacctggaggtgggcgggaggcgttggttcattggaggaaaggaatagccctgtgtgtgatgagcattgagaggaggtctggcagcaccatctagggctgaagaactaggcagtggctccagcgcggggcggtgggggggacagtgagccagggcaagaagaatggatttggccctagagtacgggttctccaaatgtaactcggccctacagatctctgagactatgtcagggggtttgtgagattttataacaaaattagatgttagtacaatatcgtgtttcgccgccgggcgcggtggctcacgcctgtaatcccgcactttgggaggccgaggcgggcagatcacaaggtcaggagatcgagaccatcctggcaacacggtgaaaccccgtctctactaaaaacacaaaaagttagccgggcgtggtggcggcccctgtagtcccagctactcgggaagctgaggcaggagaatggcgtgaacccgggaggggagcgtgccgtgagccgagatcgtgccactgcactccagcctgggcaacagagcgagatctgtctcagaaaaaaagaaaaaaagaaagattatttgcagccgggcgcggtggctcaccgggtaatcccaatactttgggaggccgaggcgggcggatcaccaggttaggagatcgaaccatcctggctaacacggtgaaaccccgtctctactaaaaaatacaaaatattagccagcatggtggaggacgcctgtagtccgagctacttgggaggctgaggcaggagaatggcggaacccgagaggcggagcttgcagtgagccgagatcgcgccactgcactccagcctggggacagagcgagactcagtctcaaaaaaaaaaaaaaaaagttttttgccttcttcattcttaagtgtacagtggagtttttcagaagctacatgatatgtattgacaccatggttcccagatgaatagaatgtgtgcctatgtattctcgtgttttaaatttttctcacttttaagtttagtaccataaatattgatagctataacccacatacccaaaagctttttggggtccttgtgatttttaagaggtcctgagagaaaaaaattttgagaaccactgtcctagagctccaaaaggtgaatgccataagatgtgtgttttttaaaaaagcatttctcgggcctggtgtggtgctcacgcctgtaatcccagcactttgggaggctgaggtgggcagatcacctgaggtcagaattcaagaccagcctggccaacatggtgaaaccccgtctctactaaaaatacaaaaatcactgggtgtggtggcatgtgcctgtaatcccagctactccggaggctgaagccacagattgcttgaacccaggaggcggaggttgcagtaagccaagatcatgccactgcactgcacctgggcggaagagtgagactccgtctcaaaaaaaaaaaaaaaagaaaaattatccctttataagtgaaagaaaaaaaaaaaagcattccagccactcagtggagagagattggagggttaggagcagatgatagggtattattttagggagctactacagaagcttgggccagagagatggtggcttccacaggatggcagtgagtgccctcactctgctttctggaagagaggaggtggtgaggaattcaggatattaaaaggcagttgaggtgtacatggtcagtttagagaatataaactatcatgggcacagatgatgggagaaggatgaggctaatattttctgccctcagacactgtgctgagtgctgtatctcctgcatcttcttaaggagatacactgtcttcctaatcctcctaaaagtcctctcaggctccgctgtccaatatgacagccaccacccacataggctattgagcatttgatatgtggctagtccgaattgagatgtgctgactatttaaaaaaacacctgtgtttgaatacttaaggtgagaaaagggctgcaatttattttcttttcttctttttttttttttttttttgagacagggtctcactttgtcacccaggctggagtacaggggacaaccttagctcattgcagcctcaccctcccagattcaagcgatccttctgccacgctccccaagtagctgggactatagctgtgtgccaccatgcccagctaatttgttttgtttgttttgttttgttttttgagacagagcctcactctgttgcccaggctggagtgcagtgtgcgatctcggctcactgcaacctccacctcccaggttcaagcaattctcctgcctcacctcctgagtagctgagattacaggtgtgcaccaccatgcccggctaatttttctgtattttagtagagacggggtttcaccatgttggccaggctggtcttgaactcctgacctcagtgatccgccctcctcagcctcccaaagtgctaggattacaggcgtgaaccaacgcacctgccaagactgtaatttctttttcttttttttttgttgttgagacgaagttttccttttgcacccaggctggagtgcaatggtgtgatctcagctcactgcaacctctgcctcccaggtcaagcgattctcctgccccagtctcccgagtagctgggattacaggtgccgtcacatctgctaattttttgtatttttagtagagatggggtttcatcatgttggctaagctggtcttaactcctgacctcaggtgatcctcccgcctcggcctcccaaagtgcagggattacaggctgagccatcgcacccggcctgtaatttcttatattgtttacatgttgcaataatattttgatgtacaggttgagcatcgccgatccaaaactctaaaatctgaaatgttccaaaacctaaatttttttagtgccaacatgatgccacaagtggaaaatcccacagctgccctcatgtatgggtcacatatattattaaaaatattgtggtcgggtgcagcggttcacacctgtaatccaacgctttgggaggccaaggcagcgggcggatcacctgaggtcgggagttcgagaccgcctgaccaacatggtgaaaccccgtctctactaaaaatacaaaaattagccaggcgtgtggtgggtgcctgtaatcccaactactcgggaggctaaggcaggagaatcgcttgaaccgggaggtggaggttgcagtgagccgagatcgcaccattgcaccccagcctgggcgacaggactctgtctcaaaaaaaaagagaaggaaaaaaatcttcaggccatgtgtataaggtgttaggaaacataaatgatttctgtgtttagatttgggtctgatcccaaagatattaaataatgcaaatattccaaagtctgaaaaaatccaacatccaaaaacacttctgacccaagcattcagataagggaccagaattattagattaaataaggtatattattaagttaattttactgtttctgcttatttttttaatgtgagtactagagtatttaaatttacatatgtggcttcattatctttctattggacagcactgcctaagtaactttttaaaatccctacacccaagaaacatatagattaagtagcatgctcaaagagtcctacagttaggatatagtgccaggtttaacccagatcagtgtgaattccaagcctaggttctgcctaccacaccagcagcctcctccatgggttttgagataggatgaggagataaagtgacaagggaaagatacagagaggtgagcactgtaccttctttgaatccttgcaggtggacaggtagacagctgtggggaaagatgagaagggatgggatgctggagtggtagaggtggagggcagagggatgggtgtcaggccttgggagtaggtggggaaagtccaccaacctcaggtcatggtcagggtagggctgacattaccagcccagcccagtgccttgaagagcccaagcagaagaaaggcagacaggaaaagcctacgctgtcctcaagggagggccctgaaagacctggcaggcagaaggggtgagagtggctcctgtcttcctgggtgctggctcagattccgcagagctcccagctcttacctgctactccagggtgacctcagcgctgcgccccgaggcaggcaggctgggatggtgaattcgacggcatagcgtgccccatgctgctcagtggtgactgggggcggctgcaagtgcccagagagctgacagagccatcggaatggtggcgcagggccgagagccacctctgcccctcggcctctgagagcggccccctgggccaccccggagttcccactccacctccaggcccccagaaggtagaagtgggacacaaggcagagcaattccgggggtgcctcccctggggcggcccgtgaagggttgctggcatcagggacactttggggggttctggggaaagaggacgaaatgagctagggaaatcagtccatactgtcctccctaagagaccctcagtttgcctgctggcttcccagaactaaagaaggttaggtttcttctcctgaaatagggaacccactgtctctccattgtgcgtcacagaaatacccatgtcaaagcccctcaaatttccaggaaacttctagcctccattacccctctaactcccaggaacctctttctatctctacttacttgcccaggcaccccttatccatcatccctccccctattacggtccccacaatccagtgcccaccctctaccctggagacctctgtcccccaactcactgtacacagcaagctccagggtgacctgtccttgaggtatggcaggtgtatggtggccagataggtgccctcctgaaagggttgaactgtaggagccagaaggtcccatttccggtccatgggccccatggctcatcatcatcccaagcagcaatgccacggccccttcttgggctgctggcatctggccattcagcccaggagttgcagcaggagcagatgtcccttacccaggtgctggcgtcgccactctagcccaaagggagggggcccggagccagagatgaggcggcctcggaggtggggggcatgtaggcaaagctcaagtcagcagagcatcttgtcccagtctcactcgaggggcaggggtgtgggtgaggacagtcagaccactgaggaagacagggagatgaggggttgggaggggcatgagggagagaaagaagggaaaaaaatagagaaatgcagttattggggagggctaaactgcagtttacccacccctcgaggacaccttttctgatactcaccatttcctagccctccctgcaaactccttttgctcgcgactgggtggcacctagtgtggctgagggtgagcagagaggtctaggggtggtgagtggggcaatgagggggtatggcctttgaagcctactctgaacacatagcacactctagctgggggactgcagaatccgaggccacttctgacacaacctgaaccactctatctccaagcccacccttgaggaaccaggcctttcttgattacaggcgaagacaatgattgagccatgatgtcagtcttgtggtgctgtacagaatatttactgactctagaaggttccagctctagctagacctgagcacagacctctatgctctactgaagcagtacagtgcagtggctaagtgctggagcctggctgaccgggttcaaatcccctctgcagcttatttatatggccttgggcccttcctttttccatggctcagcttcctaatctctaaaattaaaagttgatgataataatgtacctacttcatgaggttgttgtgatggttaaatcattaatacctcttgctactcaagctattcagttcccaattttagataacagagacacctacccatgaagggtgcttacaacatgtctggaacacagtaagtctacacgtgtttgctatagttacacctaacttagcatacccaagtcaacagcatctctgcaacattccccaccctgctccaatgcccatcttccctgtcttgatgaatgatcaccaagcccgccagacactaaaagcaaacccttggagttactcagatcatttattcattcagcaactattgagcactgaagatgttcaaggtatcctggtagaagcagaatggtgaacaagacaagcagtccctgctctcaaattgcctatagtccaatgacagcaagcaaattgtcaaaaataatgtgctatgtgctatccccaccaggacctaacagatctacatctgtttccaatttaggttctcatcaatgtacgtttagacaattacaacagccctctgtctggtctccctattctcagtctctccttcaactccttcttcacactgtagccaaacaagtgactacaagtctgatcccatcacctacctgtttaaaaatcccaaatatgggccagcgcagtggttcatgcctataatcccagcactttgggaggacgaggcgggtggatcacctagttcgggagtttgaaaccagcctgaccaacatggtgaaaccccgtctctactaaaaatcaaaattagcctggtgtggtggcacatgcctgtaatcccagctactcgggagaccgaggagtagaattgcttgaacccgggaagcagaggttgcggtgagccgagattgtgccattgcctccagcctgggcaataagagggaaaccccgtttcaaaaaaaaaaaaaaaaatcccaaaacggccaggcgtggtggctcacacctgtaatcccaacactttggtagcctgaggcgggtgattacctgaggtcaggagttcaagaccagcctggccaacatggcaaaaccctgtctctctaaaaatacaaaaattagccaggtgtgggggcaggcacctgtagtcctagctacttggaggctgaggcagaagaatcacttgaacctgggaggtagaggttgccgtaagccgaaatctgccactacactccagcctgggcaacagagtgagactccgtctcaaaactaaataaataataaaataaaaatcccaaatacctaggaagtcagctgataaaggcataggctgaagctaatggcctgggttcaatttctagccctgcttcttttttttttttttttttttttttttgaatagagttttgctcgtcacctaggctagagtatagtggtgtgatcttggctcactgcaactctgcctcccaggttcaagtgagtctcctgcctcagcctcctgagtagctgggattacggcgtccacaaccgtgcccagctaatttttgtatttttggtagagatggggtttcaccagttgcccaggctggtcttgaactcccgacctcaggtgatccgcctgctttggtctcccaagtgctgggattacaggcatgagccaccacgcctggcctctagctctgcttcttacacatgtgtgtccttgggcaaattatttaactggtttgtgtcctatatttatccatatgcaatcagggataatattaaaacctacaacctatggttgttgagaggaataagtgagattatgctataaagtgcttagaacagggcctggcatatagaaaatacttgataaatgttagctgttctattttcattaccttcatcactatcatggacttgctggttaacttggaaaaatcatttacctgtattttcctcactagtccaaagatctgacctttgcctatcttttaaaagaatcagtaaaataacaggctttttccgggcatggtggctaacacatgtaatcccagcactttggaggctgaggcgagtggattacctgaggtcaggagttcgagagcagcctggccaacatgggaaaccccatctctactaaaaatacaaaaaaaaaaaaaaaaaaaattagcggggcgtggtgtgggtgcctgtgatcccatcaacttgggaggctgaggcaggagaattgcttgaacccggaggcagaggttgcagtgagccaagatcaccccattgcactccagcatgggtgacaaggtgaaactccgtctcaaaaaataaatatgtacataataaaaacaggctttttagaataaacgccctccaaaagaacttctgatggttcgctctcacctacagaacaaagcccagctttaaggtatttgaacattcagcccctaacccacccttccaggcttctcctgcaccctacaaccagccacatagaacccctttcttgtgcctagtagaagtggtcatcattggtcatctcttgctttggtcatgaggtcccttcagtttacattgtctttcccattttctcccaaacatcatcaagcttgtccaacctccagcccagggaccacatgcagccaaggacggcttggaataagcccgacacaaattcataaactttcttaaaacattatgagattttttcacatttttttttttagcttatcagccatcgttagtgttcgtatattttatgcatggcccaagacaattctctcccagtgtggctcagggaagccaaaagattggagacccctgatctaaatactccattacatgaaggtcactttcactgctgtttcttcccagaaatgtctaggtccttcaggtagagtaatctttttcttcttgtaattatttttatgttctttttaatcctagcttctgaggctataaggttaaactgttctcatcttcatggaattgttcagtagagtaaaaacagtatgcatttcacttagtttgtcaaaatccagaaacatacttttgaattgttaaaaaaaaaaaaagatccacaggctgggcacagtggctcacgcctgtaatcccagcactttgggaggccgagccggtggatcacctgaggttgggagtttgagaccagactggagaaaccccgtctctactaaaatacagaattatccgggcatggtggcacacgcctgtaatcacagctgcttgggaagtgaggcaggagaatcacttgaacctgggaggcggaggttgtggtgagccgagatcatgcattgccctccagactgggcaacaagagcaaaacttgatctcaaaaaaaaaaaatccataaattaataaacaaaacctggctgggcagggtggctcagacttgtaatcccagtaccttggaggctgaggtgggaggatcacttgaacccagcagtttgagaccagcctgggcaacatacaagaccccatctctatttaaaagaaaaaatttaaaaaaataataaacaagacctaaagttttacagtttaactcttttttttttttttttttttttggagacagggtctcactctgtacccatcaaaggtgcaatcctcccaacacagcctcccgagtagctgggaccataggtactgccacgacacccaaccttttttttttttttttttttttgagacagtttcacgcttgttcccaggctggagtgcagtggcatgatcttggctcactgcaacctccgcctcccaggttcagcaattctcttgcctcagccttccgagtagctgggattacaggcatgcaccaccatgctggctaattttgtatttttagtacagacggggtttctccatgttggtcaggctggtcttaactttcgacctcaggtgatctgcccacctcggcctcccaaagtgctgggattacaggctgagccactgcgcccagcatttttttaatttttagtagagacaaggtctggttatgttgccaggctggtcttgaactcctgagtgcaaatgatcctcccacctagacctcccaaagtgtggaagtacaggcgtgagtcacctcacctgactccataatattttaaaagaatggtgagattaaacactatacacacaaagtatattaagaaagtataggcctggcgtggtggctcaccctgtaatcccagcaatttgggaggctgaggtgggtggatcacctgaggtcaggagttcagaccagcctggctaacatgaccaaaccctgtctccactaaaaatacaaaaattagctggcctggtggtgggcgcctgtagtctcagctacttgggaggctgagacaggagaattactgaactcaggaggcagaagttgaaatgagcagagatcacaccattgcactccagcctgggaacagggtgagactctgtctcaaaaaaaaaaaaaaaaaaaaaaagtatatttggggccagcagctcacacgtgtaatcccagcagtttcggaggccaaggtgggcagatcaattgagccaggagtccaagaccagcctgggcaacctgacaaaaacccatctccacaaaaaaaatacaaaattagctgggcatggtggcacatgcctgtggtctcagctactcaggagactgaggccgaggatcacttgagccacggaggtggaggttgcagtgagctgagatcatgccactgcttccagcctgcactgcactccagcctgggcgacagagggagaccctgtctcaaataaataataaataagcatatttgtcaataaacatttaaaaatatttgataagacaagtataaatgatattagcaaaatcatgaatgatcttggaccctggagagatttcatttctaattttacacagtacaacagctttcattttcttaaatccctgatcaagcagaaatgcttgaaaagaaaagcacagcaggccgggcgtggtggctcatgcctgtaatcccagcactttggaaggccaagtgggtggatcaccttaggtcaggagttcaagaccatcctggccaacatggtgaaaccttctccaataaaaatacaaaaattaggtgggcgtggtggcacaagcctgtaatcccagctctggggaggctaaggcacaagaattgcttgaacatgggagacggaggttgcagtgagccagatcatgccactgcaactgcactctagcctgggcaataagagggagactccgtctcaaaataaataaataaataaatagcaggcaggcgcagtggctcacgcttgtaatcccagcactcgggaggcgaggtgggaggatcacctgaagttgggagttcgagaccagccttaccaactggagaaacctcatctctactaaaaatacaaaattagctgggtgtggtggcaggcaccttaatcccagctactcgggaggctgaggcaggagaattgcttgaaccagggaggcggaggtccggtgagcgtgagatcacgccattgcactccagcctgggcaacaagagcaaaactcttctcaaaaataaataaataaataaaataaaaataaataaatagcacagcaccttgctttaccccagttgtttgtgaaatacagacaatcttaccacccgggcacttccagggctcccttctgcatgtccttcactttctactttacattaggattatccgtggcaaatacgcccagacctcctggagagcagagtctacatcagatcatctttgtgacccttaagggcacccagggcaccccagagattctgatttaatcggccaagctaagcatgggattgaatcaggtttcagatattttagaaacctccaacagtgtggactgagaactgctgagtcctaactcattcttgtgctaaaaagtatttattgaatcaatggataaattaacacagtgccatctcttgatagtacaacaagaaaagcagctgggaaatagtatccacattttacagttggaaaaacaaactcgaaagcaaagaccattctcatcatcacctcggtggagccagtagccctaggaaatattcaccccaccagagagagctactgtctacacaagagcagtgttcctcagcttctgccaggggggggcttgagactaagaatggaggtataggcagaggtgagggtttcagcgtgggtttcagtctgtctccctggttctgtgggtaattctcaggagggtggagggaagggagggtgcaggattggttggggttgccctgtccatcgggctgtgtcgctgacataaaatccagatagaaagctaagaactctaccggtattctaccccggaataccccgcctccgctgccaggaggggagctcccagatatccaggtcagactctcctcattcttgaattatctgcacagtccctccacgtcccagcctagaaaagcttctgactcctgggcctcaaactgcaatgcacctttcatgcaataggagctatccaatctccagccgcgtccatccgcccactcgagcccacctgttgcggaccacagagcggcagcacatccctacacggggctgtcaggcaaggtcaacgcgctgagtgcaagagcctttgctttgcggattgccgcagcgccgggtgtgggcgcaggtggggtagagtgctgggttttgaaagagtgacccgcaaagctgagggtgcagagcaagacacagtctgggaagagcagagaaaaaacgctcctgcttctgaacccctcccacctcgcatcaccgacaagtctctcaaggtctggtgtcgggaaaccccacctcttcaaagccccgcccttcgaacaccagaaagtaacccccctgcccggccctgctttccccctaccccctgccaagctgagttttttttttgttttttttttttaactgggtgagggctagaaggagcggtagagattattcattctagccaaaccacctctcttaacaaaaaaaggaaactgaaccccgattggcgaatgtcttgctcaagtccataaagcgagaccaccggctgatctggacccttagaatctaccacccttctccacctcccctccccagctacctgttgccatggtgatgagaacaggctctgctgaggctctggctgtggtcgcaagaggctggagaggctgaggactgggctggatatctgaccatcagccaagccccatccagggcccgcgggcagttctgcgcgggggtcaggccctggcccatttcgcagaggcggggagaggcacgaagcggctcatctcgcagtgtggtgcggggcgccccggggataccgcctgaaggcagcctggagggcgcccgcggggtctgagtgagagaaggaagttgcagctgtagagtcaccgccgggaaaggggctggaagggcagcgttggggaacttcaaatgcacagactaccccgtagtgagactcactttacaaaggggaagctaggcctgaggtcactgccggatctaaagaggagggggtttcggtggaggcgacagaggtggggggcggcgagtccctagagactcaccgtgtacactgagatagagctcagggtcgagtccggccggggcggcggttcccccggtccctggcgcaacagcagtgcaccgggtctcttgccaggccctttccgctcgcatcctccacgaaccaacactcgatcaccgcgggtcctgcgagacggcggtcgccaggcctggcgtatagggacgcgagtgaggagcggtttgtatgtcggtgacctgccccactcccaccctggcatcggctccagtggggccacctccctccgcttcctctagttcttgggcgatgagtcgcggggttcgctcacccaaagccacagcgaggagcgagacagggacttcatggcgctgcgacctcctcagccatgaagcctcctcttcctccttcactttcactttcctccaaagggcggcatgaggggcggtggaaatccccgctctggttagtgaaggtgcctgggggaccggtgtttccccactggccaggcagggacccgggtagatctctccagttctcaccaggacaccccagccttaccgcgccctcctggactacccagcagcccgagttcgagccctccccaaccccaggccctcccccgccccccaactcctgtgtgtgcctccaacatccacttgcccgaaaaccattactccggcttccccctatctgtgccgcgtcccagcaaacacacgggttatcgggaagccaagtaaatgaccaataaatattttaatcacgttaaaaaaaataaaaaccttgtactcctacgacttactccctccttgtctccacccaccctccatgagaaccgagttgggaatttccacgggaagtcgggggtggcggggagagacaggtagaaataaagagcgcatccttgagagggggtaggttctaggacaagggtggggctcaaggccttgtctccacgacaacacaaacacagacttcaggcacagactacaaccacctgcccctgaccctgtgactgcaggatgttcaacacgccccctctccctccctccatgtgcatctactctgtggagcaggggcttcagtgtacccatcagagggaaaggaagggtttagtttggaaataccttgggggggaggggttgagtagtagaatgggcgggcgatggtgaaactgggttccccttccagaatatatacaagtccacagagataaaggaagacagtaagtgtggtggagatcacccgggggccacagcgcccttgcatcgtgctccttattccctttcccgaaactaccccaccccagtagcctgccccttcagtttgctcctccacctccaccgaagcccattccaccttgtggactctgggtggggaccagacacgtctgctggacgggggcgtggccgcctcgcttcgtcgccgctgcccccgcccactccgggagactctctcttggacggcaaggaggccccgtgggagtcccaggcccaggtacggccccgaccccgcccaggcggtgccggcgtcacagtgtcctcggtggcgcatgaagctgtctcgccacatgaacttcttggcgcagacccgcactcgtagggcttgagacctgtgtgcgtcttcatgtgctcagtcagatggtgcttatcttgaactttttgttgcacacggggcagtcaaacggccgcagattgaggtgcatgttacgtgccggtcccgcatgctcttgtgggagaaggccttcccacaatggcacagaaagatttattcccgtccccactgccagtccctccagggaccccaccaacgctacccggcacaccaggctccccaccgacgtgccccccacggtcactgccccgtgttctgcttggttccctggggttggccaggagcctgtgaggatgaggatgaagacgacgacgggaagaccaggatctgttgccctgcatgtccaagggaaggagcggtcgaggagggtgggagggggcataggaagaggagttggcccccctgagtcatcaagacctgccacaggacccccaccctcatatgggccaagtcattggaggactcacagaagttgacctgctcctcccccttgtctgggggctcactagggtacggacatcacttatgctgagggtagcctcaggccctccccccactggaaccctgagctaccccctagttcttcatcttcatcatcctcacaggtcaacaccagatcttcctctcctcttcctcctccagatctgggtcttggggaaccaggggtgttggcgctgggcaattccacctcgcttcacgtatacccagtgtttctgtggcatgatgctagggggtgtgtaggtggtctccggagcccagccccaggaaccactgcccccctcccatccccaccatcatcgcaagctcatctgcctccagcagcagctttccagatgtggcccctccactgccaacgacagggctgggaatacagggccacctcctcgacgctccccactgcccactgcagaagctgcaaagcctcttgggaggaagatgagaaatcagtggactccctggggctgaagtagttgctgctctgggagattgattctcactggcccggctggaggcatgggagcgcgcagagcccatggtgcaggggccacagtgcccccactcccggatggcaccccagcaccagggacagtgacagagtggctgcagcagtagtgatggtggtggtagctgaggcccggccttctcggagtagttcgtgcacttgtccacaatgtgccacatttggagcacagaccccactgtaaggaagttgacatgtcagcagcagccatgctgaggcggccagtgtaagcggaggctaggacagtctcaaagcgcctgggtccatgacactgggcagcgagatggaggtcatgcctttgagtaggacctgtcatggaagtaaggggaggaggcagccaggacagcccgatgagcccggaactcccggcctgcactctgatagatacatcgcagagctggccctgcagacgctgctgattgagggactcaagagggcactggtcacctcagggaaggacacatgtaccactgcagctgctggcaggggagtgggggcggagccagcgacagcggcaggggaagtgctgccccactgggagacagagggatggctccatgttgtggagggaggggatacccccccagccacaggaacaaagaaaggagagggcggccgggggggtctctgggaagaaaaagagaaaagaataatgataacatctcaaacgacacagcccgttacaactcaaaaatatgttcacgctcattatctgtgtaactcccacaacagtgaggtaggtattcctctcaaccccatttgacagatgaggaaactaaagctcgaaagattaagagattatccaaggtcacacagcaagtggcagcgccagcaaacacaggttctgacaaatcttgtgccctttccttggaggttagagaaataaggtgctcttaggggctgagtggcttccttcggaattataccctatttccgacttacctgagagcctgacattccaaatctacctttttggtgttttgcacccactttttgggagggggcagggcagctctgctatgaaaaccaacgcttgctccatctcccctcaggctatgccccccaagctctctcgccgacacgccccctttcgccccagcttctctagccccgcccctttccaggcccaccccccccggccccgcccactatcgggcctttcgaccccgccccttgtctacctccgcccacaacggacccgcccccccccgctccgccccaagcgctacctcggcctcttctcccacccggaaggcccccccaacctcgcgcgtccccgcttaccgggccgcgcgcccccgggccccccccgccctcactcggcggccagagcagcaacctgggcccctcccgccgccatcttgcgccgactcctccgccctccgcctccgctccgcctcccgcccctccgcctttaaaggcacagccgggcacccgcccgtgccgctgggcaatactcggccgactcggccactttgcctttaaagaaacacgccacattccaccttaaaagatcaggtcccctcctccgctgggagctcaggacttggtcggccgaagcatttattcccctttaaagctataagcctgccttttcccattggcgatggtccaggtatcgttccccaggctccgcctctgagctgtgaccattagctggttggtgggactaatcgccctcttcctagctccttacagtcccactgaagccccgccccctttctccggcctggattggctaaataaccttgagtcggcccctcattggctttctcactcctactgcagaagtgaaaaagtaaagtgcgttaaggcggctgaagcacttaaaaaaaaaaaaaagtacgcctgaacaacgtggcgaaaccccgtctctacaaaaaatacaaacaacaaaaacaaaaatagccaggcatggtggcacgcgcctgtagtcccggctactcgggaggctgaggcattatgcttgagactgggaggtccaggctgcagtgagctgtgatctcaccactgcaccctggccgggcgacacagcgagacaaaaaaaaaaaaaaaaaaaaaaaggccaggctagaaaggacaagcgggactaccccggggatactgggctaaccctgagcaaggggacagctaatgccaattgtaacagtagaaggacaagaaaaagacagtgatacagtaagaaaagaactttattgttattaatgtttctgtgtaaaacttaagcttttttttttttttaaagaaacaccaccaaaagggattagcttagtccatcccttcctcagtcatctgcttcccaccttcctccaaatgtttcccagaacattctggaggcagggagaaggggaggcagctaatcagagtctgagagcacatgatctcttctggatcgcattgtgtggccacacttgtctgcagggaagtgagagacaagagtcaaagagatctggagtacaggagaaaagaaacaggaggatttagaggataaaatggtgggaaaaaggaagagacaggatgtggcacgtggaatattcagacagagcagctgaaaagccaatgaaagagaacaaattgtcagaggaaacacgccctccccttcttaccttgcaataccaggccgaggaggctgtgaatggggggtttgggacagccgggctggagaagggatgagagggagctggtcaccaggccatggctgggagagtccaccctcgtggaggaatcagcactggggccaaggaagccaagggggaaggtgggctgggcagggtacatatctttttcccatcttctcatgcactgacctttgcctttccacatagctagaaacagaaacataaatatgtgaggggtacgggaagactgaggctggaggggggcagtccagtctctcccagcagactcattccccagtattgctctccgaaagtcccctgcaatccctccttggcttccctcttcctctcctcttgttattacctgtttcctaatggccctgatcctgtttgcttcttctccttccggattttttgcaggggggaccagaatctccccagttgtgaggagagacgcctccattgaagaagtagaagagaccatgcctgctccattctctaagacagtggtgaagggctcctctgatgcttcctggaagaggaaatgtccgtctccacagaggaaggggtatccaggggcaaagctcaatctctagctcaaagagctgagacacagggctttcttcctccagggtcagctcctcggctgttctccattgctttcagcatctatgctggagggggccaggggttcttctgacagaacgatggtgacactatgcgtcctttgttttgctgctcccctgaagatctgctgatctgttgccaggttccaggttcttttcattggagatctgtagtgaggacatggggctcttgtcccatctttacctggaaaagaagaaaaggggagagggtagcctgagaatgagggggaaaaatactgctgagaggacactaggaggaggaagggaaaggtttcaaacaggtggctcatgctaacaaaacagaaatgacaggtgaggagaatgttcccttgacatacctgctgctgcttctcctcttcgtcctcctcttcatcatcctcctgaccctcctgcatctgttccagatcctctcctcttcagaatctgtggcctcctcctcttcttcttcctcctcctcctcctcttcctctcactctcctcatcgtcttcgtcatctgtctcagctctggaggcagaagggcacccctggatgccattccactagggccctgggagacaaagaagtttctctaaggaatcccttgcccagagggtttggttcttgctttccttctcatgctcccccatcagtcaacctggactccctgtggccagtgcaggggaaggacaatgtctctctgaaggctgtaccccatccacacctcac

SEQ ID NO: 5017 - DNA, 19521 bp, Homo sapiens
cagtctcatattatgttttgtttgtttgtttgtttttgagacggagttttgctcttgttcccaggttggagtgcaatggcacagtcttggctcactgcaacccctgcctcccaggttcagcaattctcctgcctcagcctcccaagttgccggaattacaggcccccgccacgacaccggctaattttgtgaatttttagtagagacagagtttcgccatgttggccaggctggtccaaactcctgacctcaggcgatccacccgccttggcctccaaagtgctgggattacagggtgagccaccgcacctggccatattacgtttaattttataacctaaaaatgtgtgggccggcgcagtggctcacgcctgtaatcccaacactttgggaggccgaggcgggcagatcattgaggtcaggagttcaagaccagcctggccaacacagtaaaaccccgtctctacaaaaaatacaaaattagctgggcatgatggcaggtgcctgtaatcccagctacttgggagactgggcaggagaatcgcttgaatctgggaggcggaggttgcagtgagccgagatcacgccacgcactccaacctgggagacagagcaagactacgtctctctcaaaagatttaaaaaaaaaaggtcaggcgcagtggctcacgcctataatcccagcactttgggaggctgaggcgggcaatcacttgaggtcaggaattcgagaccagcctgaacaacatgctgaaaccctgtctctataaaaatacaaaaattagccaggtgttgtagcaggcgcctgtagtcccagatactcgagggccaaggcaggagaatcacttgaacctgagaggtggaggttgcagtgagctgagattggccattgcactccagcctgggtgtcagagcgagactccatctcaaaaaaaaaagttgtgtaatttgttttctcttggtatttaaatgcctacatggtaccctttgattttacctcttacagcaaatcataaaatatttactatctgactctttacagaaaaagtttgtggacccttgaatggacactcatatttccattttcggggtcaggaaactgtggcacacagaggttatgaatatgcctatacttgcaaggcccatccgtggtaacactgcgatttaaacctgggcatccggctttagactctgtgctcctaaagcacactgccttccacacctttctgcccacctatgctcctaacacctcaccccaccagtgacttacgtgcctgtagaatctactgccacagcccgaccccaccacgatgacagagaatctttgccagtggctccttcatagctggactccataagacacagtacctggaagagaagaagaaccaaagttgctaatacacacctaagcctgagttactaaacatgggaaagatgggaactcaagaccaagagataacaaaaaagggaaataaagggtaactttaagggactcatgaagtacaaatatagaagaaaagcaagtcaggatggtagagtcaaaactaagccaggtactgaccattgctgtgtccgagatggatgacggcattgaagggttctgactcataacatcgagccgcccagctcgagcattcagagctgccacaatctccccactgacacatccaggtaggttagaaaccctgtttctgactgagagagaaagacaagagaatgacccagtcctgattgccctctgtattccctctgctggggtcctaaaggagagtggtcatcccaagggcttccaaccagttcctgagctccatggccactcacagctgtagcaggaggaagtggaagggcaggaactcaagccgtgttactcggtcacagcggcggatacgtggagctcaatgccctgattgtcatagatgtggagccagcggttctgagcaacagcaacagtgcctcagaatggagaaacctgggggagaggaagagtggttcaattgggaaatgagtcacaggctatcattcaatcaggaatggactatctcaccccaactgaccgctgacagtgggccactgaccggatgtcccgcaccgcctccatgacgttgatctcgcacataagcttcttgttacccaatcaagggcagccacatgacctcggcgccctccaaaagccaggtgtctgtggaggtgaggggcaggcagggtgttaaggcaggggaccaccgactcagacaacttgaggctgccccacgccagccccatctctccaggcgggcagacacatgttgctgtaggtgcttacctcacacccaagcaaatcgaaggaccctcccctcatcagcaacccaaacatacactggaatggctgaagtggttaaggaaacacatcttagttcaagagtcactagaattcaaccttccttccagttcgagagtagtttagtctgtagggtccaaactgccgcagattcaagtcaagtgctgggaaagagaagagtgaaaaaaaagagtgccctgcagtaacgccttcttctagccccattcctctattgtcctgcaccaccaatcaatcccttggctcctttacctcctcaggtcaccttggctgcacttgcaatgtccacagcctccacaatgtcagcctggcatatctttctgtgtcttccccatcctccccttccagaaacctgaaagcaagggttaggatggcagtaagcttcccaatatgaagcaagtataccaacataaaaacgagaaaagacagtcccaaaagcagggaatgggggtccagattagggctcactcacccaggttcttcagcaagcagcagctagaacgagcagctttgatacttgtttcctcttcctcagcttcagccacctcaagtcggctcgagttttggctttagaatgtggtagctgtaacattgttggtggggaggagtggcagagaaccacaggataagtggggtcacaggagagctacctgtcccagcctccatccaactcaccagacactccctgcctccagcacttcccaactctccggctggacctcacctttcgggattgtcaatgcgacagaacttctggaccacttccacagggacgggggcggggcctgggaaggatcttgggcctaggggaaaggaggacgcaattagcagacagccttggattgaccccaccctctcactctcaaggaacgaggcggcctgcctcgccacccatcaggtcccacgctcacccggacaagccgcgctgggactccgggttcttccattctcggggtttcttcgggacctaggcttcttagagatccgagacttctttaagatgtaagcattttttggtctctgaggacgagctcccgattcttcttgttacgaggaggccctggagaggctccggctgtggtcggaaggtctcttcctcccagtatcgccgcggtttctacaggcacatcaggaactccgcactcagccccgccccccgaccccacagctaaaaacttcgtttcccacccagggaggcctctaccttctcttggtctgaagtttgtctttcttgggcgggacatccttgcccggcttgggggcttctccatctcgcccacccgaacggcgatccacgtgcaaaactcctctcagctgccacacgtcggcttgaaaactcccggaagccctctgtccttcatccaatcagcagcgtaccaggttgaagctctctaggtgccatcttgagtgagggcacgctctccttagaggggcggaacagttttggcaccttatcgcgagcggcagcttatgcaagagtgacttaaaaaagaaaggcagtccggagccaggggctaagtagcggtgcggtttctttttctggattagtttccccatctgcctaaaaatgtcctagtctagtctttttagcagaactccactccctaaacatgtcagactacacttcccatcaagggtcagaaagaaacttccggcacagtcttttcccagcattcctgtttacttccgggtttattactactgaaggaagaacgtgagtaggttaggatttcggtgagaggcttggggtcttgcgtttcgcccaccatctcctggggacagggtggagtcgataccgggacgggggggaggttgcggtgcccctcagggctacctctcaagagtgctatcattccgcaggccagatcagaaaagggagctcaggtaccttccagagagtgagacccagcgccttgtctcgcacccagtaggctttcatccccgccatggcggagctgatccagaagaagctcagggagaagtggagaaatatcaacagctacagaagggtaagggaacagggtcggtatgtctcgcccaatgcacttacaacccaaagccattaccgagataaggtttgttgccccatcgggccctcgcgtgcagagacttccccgcctcagtctcagtactcttccctgttcactcaccgctgcccccatccttttctgcttcctcagatccatatccacctgactaggattgtgggataggtggcacatttgatgtttctaaattgcctttcctctcatccccagacttaagtaatccatgtcggggaggcagaaacttgaagcacaactaacagaaaataatatcgtgaaagggtgagggactgggatttgtggggcgaggagggacctgtactagccatggttctgatcaatatgtcccatccctccatcaggaactggccctgctggatgggtccaacgtggtctttaacttctgggtccggtgctagtcaaacaggagctgggggaggctcgggccacagtagggagaggctggactatatcacagctgaaatgtgagtttttattccaccaccgtgtgctgcacctgtgatgcaagtgaaccattggagtagaggtgttgaaccattgcagaacagctctccaagtggcccctagtcctccagttcctccaaccctttccttcccttttaaccccccttctttccctcccctggatctcaagttttccacctatctctttcttgcgtttagcactctccatgtgagtcctactaatttctccctttctgcttgtctcccttgtctctccttagtaagcgaacgaatcccagcttcgggatcttgagcggcagtcagagcaacagagggagacccttgctagctgcagcaggagttccagcgggcccaggcagcaaaggcaggggctcctggcaaggccgaccccatggtggggggaggggaggggaggggagggaatgaggcagctctaggatctatctgtagctaataaaatgtaaaaacacctggctctgtttcctgaccaggcacttctgtcaatccccacagccccttccaccttaacacacaccacctgtattaccccctcaggttcaaatcttgcacttggaatctctttgtggcacagtgttctttcttgaaagtgaaatcctaaattcttcaaacctacttcttgcctgtatatacaacccttaactctccctcatcttggttggatgattcttttggaagggcatttgcaacataccatattgctaggaatgtcggtttaattaaaaagaatacacagttctctaacctgaggccccaggatgaaatgtggttaccctccttccaacagccctggcatctctattagtacttttcagcctctgtcttcctagaatttgcttaatgtagctttaaactgacttaaaatcccagcatgtaatgctttatggtattataagtctcccaagtttatatgttgtccataaagttgttctgccatttccttgtcctaaaattgtttatacacatttgcagcaagggaccagtggtagagaggttactggagagaaactgttctgggaaacttttttcaccaatacctcactttttgctctgttcatggggacagaaaacattggccccttcctgttccatggcatctaccttcagccaattccccacccccactcatagcagcagttcatatgtactgcaaggacaggggagtagaattcaggtagtgttttggtttattacttagtgttgtcacagtgatagaaacccccagagtgggaagaagagctcctgcgaggactacattttgccattcccctctgccctggggctcagagccttgaagcctttgcttggccctgcatgttaggatatggccaagaatcagaaactgatgcgtttttccagcactacctgtggctgcactcatggaaggtgggaagctatacacaggtatccaacttggttataagacaccgttcccacagggctggatttctcagctgtctggtaaaccagtggcacttcactgccccaggtggctggctccctttctgaatttctgtctcaatgtgatataattgccaccattcaggtggctacccacatctggtatgaacaccatgacttctgtaagccaacggggcttcctcctagaacagtgcccgtgcaatcttcctccctgtggccttgatcctgggaaaggagccccctctccctcactcggaggagttcctgaggcagacgggccactggtgacgccaggtgtagcatagaggaccttcgccgctgccgcaggaggaaatcgtgtgaagctccatccatggcgtagatacattagccgaggctgggatagtcagctctgaaggttcaggggatggatgtaaagcaacacacagttgttccccccacagccgcccagatgtggaagtactccactctcctcccgatctgcctttccctcatggcctctgacctcgctcccctggtagcagctgtaccagctcatctctgaagccactgcagagtcacgattgtttttcttaaggacacgactgatgacacttgagccttgtcctggcttgtcacctggcagaacaggagaccaaaagagcaatcaatcagcctgatttcccatccttctaccctcagccactgaacccaaccacaaaatgttacttgtgtcaaggctttaaaatgaacaggaaaacccaatatggtggcttcctataccccataagccagccacatggtgcccagtgaaacagagctgcttccctgtggggaaactgctgttgattctgaattttaacacggcgaccaaaagtttaaggtgtagcaactaatgcaaaatagccatcaaataaaacaaatttcagcttctattgaagactagagtttagaagataaaattaaaaataaacataactgccaaaaccaaaggtcaaaattaaaactacattcaattccatttggctgccaaacctcagacaacatttatagtccaacaagacaccatccttcaccccaactccatcccaggctccctcaccaaaatgctcttatagacactgccatcttcccccaactccatctggatcggatgatacggcaatcagaggcccctggcccagatccctctcccccatatccagtcccccggaggcctcttctgcacccccactcagcggggagccacaggaggctgagcggcggtacctcgagaaggcctaggggaggaggctggtggggagaggtggctggggtcagctggacgtgcagggatggactgctttccaaggcagagtctagtgacgagacagatggccacttcagtgctaggaacaaacaacatgggactggcatgaaggcagggaggtttaaggaagaaacattacagagtgagggtcagcgtcaaggtcagagtcaggagcagagctcacctgggccagcgagtcagcagaggagcaggagttgtaggcgcctcatctcccccagtactgggccggtcaaggacacaagcggggtagggaccccaacagagcccaaaaccctgcagtggcaggagattggaggatcagagaaaagtggaagtcccaagaaaccaccccccagccagtgaatctctcatctgtccactgcgagatgaccaatgttggccgaagcacccgtggggcaggagggtcactgaaccaggtggctccacctcacaggatacacgatggctgggttaggggggcaataggcaagctcaggacatgacaccaatcccccacacctggccagaaccctggagtcccaacctcaccgccagtcacctctgagcctctgtcagtggccggagcccctgtagccacctctggatacatggtcaggttggaggttatagccacgacattcattctggagccgtcgcaactcagaaggactgcaaactcctgggaaggagccctcaaactgcaggagccaaaactcagggaccccgacttttccccctccccttcctggaacatggatagggaagtccagcatccagcccagacctccgctcaccttcctccgcttgtcaaaattgatgtatccattctgcgaggaaaatgggatggggtgaaagttccaaccctaccttccggccacagagagagaatatcccctctcttaacacacacagccacatccaactcacaaccacttccctccagcctctctgactcttcgatcctccctgccttcctcctcaatctatcatggcctaagcactccacttgaccctttaaatgaatttctcaggtagacaacgagtctgctttgcagatgagaggactggatagtatccaatcgacaggattccttatccagagaggataaggaacttgtccaaggtctcagtatttgttatttaacaaactctagcaatagagcaggagcccatcacaaaacctagatgtgcttacgttcaggcacgttctaagcacttgacaaatacaaattcatttaacccttataacagatcaagtagatgctatttctagtttcccatttacagatcactgaggcgacttggcacagaaacaatctggctctgtcccacactcagctatttgtgccttacagccccttgcaaggggcggggggtctgtccgaccctgcagcccacttgttacatcattgcaatgacacacacacacaccatgacctccaactcatccttggaggctgcatccagcatcacaaggtccttcaggaaggtgcaaggtatgggaccacaccctgaagtcaggggtcagggtcagaagtgcctgccattgactgagggccctccatccctccgcacttgccctcctcattgcctcagagaacagatttcatctcctcacccctctgtgcctcccttacccatccttcaggctgctcccccaaaacatactctcaccccttcataatcaccacccccacgcccaccaccccgctagtcactcaccccacccgggagccagacctcggggccttcttggagtgtggctccagaggagactgcagcttcactcctggtggtgacaaaataaaagagacatgggggagcagtagggaacaaggagaggtggaatgccacaaaccaggctctcacctgcacgagcagctcccgactctgggaataattatctcctcggagaaaatctggcagaggctggaaaagactctgaggctgtccctggggaaggggaaaagtggccctgaggacaggcctggctctgtcaccccctcttccccgccttctgaggacccccaccccagtccaatgcctcagcctccgcacctggttgcttccccccaggctgccgaagcctgtggatggggctggactgcagggctgacaccacggcataaactgaagagaagttcggagcagccggcactcctgtgggggtcaaagaagagagctaaggctatgggaggccctccattccatggccacaaaccgtagggcaatcttctctctcacctctgccacgcggatcacttctccaggagccgggccctctgtgggggacggagtggccgtatggtcacctccccggtccctctccagtggaagtagcccccaggacagaactaaccactgcccctgccaccttttaaactgtgtgacagtagctcggacagatgggcagaggtgagaatgtcctggccggtcctgtgaccccacaggcctcccaggcactgagaggggatcaaattgagaaaaagttcctgagggtagaggtcagaggttaaagttcatagtcaagtgaggtcagccttccaatatcaggatctgaggatctcaggtggccaaggaaccagaggggcacagggtttgaagggtaacgacaaagggaaaaggggagaatcaaaatggtaggtggaggaggctaggagctggatcaggaagggtggaagcaaggaaaggatctggagtcaaggagaggttagtaaggggtcagggggcaaggggccagaggtcagggtctcaccgcatctagcagggtcagctgttcggccaagtggtagcgaggaacaccaggacatccgtggggtcagcagggggatcgccggggagggccagggcttaggaaggtcgggggcctgggggtccacccgggaccggagattgcggatgaggtcaggctgccccccccaacacccttccctgctgcataccctgtctgaagtaagaagctctcaaccggtcaagctgacccttggcctcagagccaaaatcctcagggtgagaggccagccaggtgacagtacagagatggctaccctgggagaagggaatcagccaagggtgagaggtaaagtgcagcctgggcagaggggactgtgagattaagaaccaggggtcactcactctgttgtctctctagttcgtcggtaggatgagattcaagggcttccagcctgagggggagaagaggactatctgtccatttttcccaaaccctcagtggctttgactattttggtgggatgttgcgctttaggaaatccgggcagatactccactaccctgcgtcccttatgactctgacctgtcgccataagccctagcaaggcaggcgtggaggtgaaggcccggtgggtagccaggaaggcgacatgaagctcacatcagtccctgatgtccgggtatccagtaggtgtctgaccagggctccagagtgccagctcggagccgtcgggaggaacgtgggggaggcatagggacctggagacacagagagatgatcgctaaccctttctcccactctgcacctagatttctgaggacaacccagacccaggagatgttccagactcatttttctgatattcagagagggcaagagtctggcctatgtcacacagcagagtccaggactccagaactccaacctagcactctggccagaagtcagccagaggaaggaaaactgggaatgaagagtcagaggtgagaagctaaagtcagatctcaccaagggatcaagaggtcgatattggcggcttgtgacggtaaacacggcacctcctcctcctcatcccagacggacacaggggcctggaggagcaaggaaggggaagtcagcagttccacaccaccccccattgccctcagccttcaccccaggccctgctcctccctcttacccctcacctgtggtggcagggcatagtaccagcgagtgcgaggaagggttgggggactggtgaccccaggtctcccccactggggcccagacagccccaccccagccgcctcaggccccggtggagtcgaaggggctgcagtggaggcgtggatggagtacaggaattctgatctggagacccccaaagccccttctccccagagctgaacccacacacgacagagaagcaggtacaaagggcaggagagggaagcgagaggcagcaagccagaggcagcgactaggggtagtgaaacctcagtccaggcactgccgcatgccccgcccctcccggccaaggactataccacccagagaattagtctttttcaggacccctttcaccctggtccctcgggtagcgcctccctatctcagccctaagggacccccgaaggtagcagctccaatcccagtacaggaaggaaaggggaagtgggatgatagggggttgggggcggtagactcagagagtcacgtggccccacccctcccccgaccgatcccgaaaaaccagccctgccagtcaacctgccctcacctaggtctggacctaggagtttagggcctcggggccccaaatccaaattctggcccctcctgagcccgaaatcctgctcctggccaccaccattaatccctaatgaaaacagatgaccactcttacccaccctaggatctttcctccaggtcccagaaccgtggcttcccggcctctacccagaccggggcggggcgggggggcggggggaagggggagagagggaaggaggggtcacgaatctgagggttccctccccaatcccagagtcagaggagctggttactgtggaaacaaaccctccccgccaaacaaaaacaaggagggagacagggaccaagacacgactgctcagagagtaggcacactcaggcaggcagaggtggagggccaaagacccgcagggacaggacagccaccagaagttccaggcaggaacagggcaggttcctgcgggcaggtcctgagtcacactgaagagaaccacggagacgccaggactccccgcagcagagaaacgggccgacacccagggagcgcgagaataactgaggcaaggaggaggagatgtagggacccagagacaagagaaaagggagacttcagaaatacatacgccccctacctcccaccacccgcgtctcacctcttcttttcctcctcctcttcctcctgccccccgcccacgaccaggccacctgggcccccaccctttcggggtcccggcttcggaagctgctcagtacgactcccccgggggggctcgtgtccaaagcagccgcaggggccgcgggagcatggccgagtgaaggaatcagcggggtcgggccagggggcgcctggggagagacggggtggggtgggggtggagagtcaggcaggcgcgggggaccgggcagggaagggacgtgggtgggtgtcaagaagaccggaagggagttctgcaggaggttgggggagggggcaacagaagggtggaataggggggcccttggtgctgttggggaagaggaggtcacgagtacggggacgcgcagggtgctcaggctctgacctgctcgggagggtgggggcagcgtgggtcctgagccgctgttgccgtcggtctccggccccggaccgagtccctccccggcttttccgtacccccttgaacccccccgccgggctcctgggccctcccgcctttccgctcccccccgcgtccgcccgctccgagagcaggagccaaaaggggaaggaaggaggacaggagccagggccgcggactaggggagcgctggacgctcagggaccaggacccggcgcccgagtccccagctccactgtcctccgcctctacactcggggattctggagacccgtcgacccgcaatgaactggaataaagattccagtctccagcccctgggggaaggcagagcagaatttgacattcccttccccaacaataacacggctaaaactcccgcgggaagcgttcaggcggagagagagccggtcactccatccccacgggattaccctccctaccacaaccacgaatgtagctgaccgaaatcccggccgggttttccgaagggccctcgattcccgcccctcggcagggggcggggcaggaagcagccacatccggttccagattcggctctcagagcttccggcgccgagaccgagatccccgtcggctcggtgtatcctcgctggtggagtacctctgcttgagcgcatctcatgcgccagtagtggcgcccgccccgaacggtgtcgacgggcgttctctgagcggttcagggtcactggaagggaccagaggtgattggaatattcattggcttggaaaggggttggaatgagagaaccgtttggaagcactggaatacagctttattctacacgattagacccgttaccccgtgggtctggccgaccgtcctgactcggagatccctagctgcgccgccgcttccttcgtcaacatccagcagctacttgatgagcgccctccagtggccttaggtccctatgccggcgcggggttacagcagtggacagacaggccagtccctgcctcgaggagcccatgatccgcggggagacaggcatttaacgacgactcacacgatcactaaatacaactgtggtgaaccgcacaagagggacgcgcggcggtctgcggggaatgacgggccgacctcgtctgcgacccagggagggcaagggtggaccaggcaaagggaacagaggctgggacctggaggtgggcgggaggcgtttggttcattggaggaaaggaatagccctgttgtgatgagcattgagaggaggtctggcgagcaccatctagggctgaagaactaggcagggctccagcgcggggcggtgggggggacaagtgagccagggcaagaagaatggatttggcctagagtacgggttctccaaatgtaacctcggccctacagatctctgagactatgtcaggggtttgtgagattttataacaaaattaagatgttagtacaatatcgtgtttcgccgcgggcgcggtggctcacgcctgtaatcccagcactttgggaggccgaggcgggcagatcaaaggtcaggagatcgagaccatcctggctaacacggtgaaaccccgtctctactaaaaaacaaaaagttagccgggcgtggtggcgggcccctgtagtcccagctactcgggaagctgggcaggagaatggcgtgaacccgggaggcggagcgtgccgtgagccgagatcgtgccacgcactccagcctgggcaacagagcgagactctgtctcagaaaaaaagaaaaaaagaaagttatttgcagccgggcgcggtggctcacgcgggtaatcccaatactttgggaggccgagcgggcggatcaccaggttaggagatcgagaccatcctggctaacacggtgaaaccccgttctactaaaaaatacaaaatattagccaggcatggtggaggacgcctgtagtccgagctcttgggaggctgaggcaggagaatggcgtgaacccgagaggcggagcttgcagtgagccagatcgcgccactgcactccagcctgggcgacagagcgagactcagtctcaaaaaaaaaaaaaaaagttttttgccttcttcattctataagtgtacagtggagtttttcagaagctaatgatatgtattgacaccatggttcccacgatgaatagaatgtgtgcctatgtattctctgttttaaatttttctcacttttaagttctagtaccataaatattgatagctataaccccatacccaaaagctttttggggtccttgatgatttttaagaggtcctgagagaaaaaaatttgagaaccactgtcctagagctccaagaaggtgaatgccataagatgtgtgttttttaaaaagcatttctcgggcctggtgtggtggctcacgcctgtaatcccagcactttgggagctgaggtgggcagatcacctgaggtcaggaattcaagaccagcctggccaacatggtgaaccccgtctctactaaaaatacaaaaattcactgggtgtggtggcatgtgcctgtaatccagctactccggaggctgaagccacagaattgcttgaacccaggaggcggaggttgcataagccaagatcatgccactgcactgcagcctgggcggaagagtgagactccgtctcaaaaaaaaaaaaaaagaaaaattatcccttatataagtgaaagaaaaaaaaaaaagcattcagccactcagtggagagagattggagggattaggagcagatgatagggtattattttaggagctactacagaagcttgggccagagatgatggtggcttccacaggatggcagtgagtccctcactctgctttctggaagagaggaaggtggtgaggaattcaggatattaaaaggcgttgaggtgtacatggtcagtttagagacatataaactatcatgggcacagatgatggggaaggatgaggctaatattttctgccctccagacactgtgctgagtgctgtatctcctgatcttcttaaggagatacactgtcttccttaatcctcctaaaagtcctctcaggctccgtgtccaatatgacagccaccacccacattaggctattgagcatttgatatgtggctagtcgaattgagatgtgctgactatttaaaataaacacctgtgtttgaatacttaaggtgagaaagggctgcaatttattttcttttctttctttttttttttttttttttgagacagggttcactttgtcacccaggctggagtacagtgggacaaccttagctcattgcagcctcacctcccagattcaagcgatccttctgccacagctccccaagtagctgggactatagctgtggccaccatgcccagctaatttgttttgttttgttttgttttgttttttgagacagagcccactctgttgcccaggctggagtgcagtggtgcgatctcggctcactgcaacctccacccccaggttcaagcaattctcctgcctcagcctcctgagtagctgagattacaggtgtgcccaccatgcccggctaatttttctgtatttttagtagagacggggtttcaccatgttggcaggctggtcttgaactcctgacctcaggtgatccgccctcctcagcctcccaaagtgcaggattacaggcgtgaaccaacgcacctggccaagactgtaatttctttttctttttttttgttgttgagacgaagttttccttttgtcacccaggctggagtgcaatggtgtgatctagctcactgcaacctctgcctcccaggttcaagcgattctcctgccccagtctcccgagagctgggattacaggtgccgtcacatctggctaattttttgtatttttagtagagatgggtttcatcatgttggctaagctggtcttgaactcctgacctcaggtgatcctcccgcctggcctcccaaagtgcagggattacaggcatgagccatcgcacccggcctgtaatttctttattgtttacatgttgcaataatattttggatgtacaggttgagcatcgccgatccaaactctaaaatctgaaatgttccaaaacctgaaatttttttagtgccaacatgatgccacagtggaaaatcccacagctgccctcatgtgatgggtcacatatattattaaaaatattgtgtcgggtgcagcggttcacacctgtaatcccaacgctttgggaggccaaggcagcgggcgatcacctgaggtcgggagttcgagaccagcctgaccaacatggtgaaaccccgtctctctaaaaatacaaaaattagccaggcgtggtggtgggtgcctgtaatcccaactactcggaggctaaggcaggagaatcgcttgaacctgggaggtggaggttgcagtgagccgagatccaccattgcaccccagcctgggcgacagagactctgtctcaaaaaaaaagagaaggaaaaaatcttcaggccatgtgtataaggtgtataggaaacataaatgatttctgtgtttagattgggtctgatcccaaagatattaaatatatgcaaatattccaaagtctgaaaaaatccacatccaaaaacacttctgacccaagcatttcagataagggaccagaattattagattaataaggtatattattaagttaattttacctgtttctgcttatttttttaatgtgagtacagagtatttaaatttacatatgtggcttgcattatctttctattggacagcactgcctagtaactttttaaaatccctacacccaaggaaacatatagattaagtagcatgctcaaaggtcctacagttaggatatagtgccaggttttaacccagatcagtgtgaattccaagcctggttctgcctaccacaccagcagcctccctccatgggttttgagataggatgaggagataagtgacaagggaaagatacagagaggtggagcactgtaccttctttgaatccttgcagtggacaggtagacagctgtggggaaagattgagaagggatgggatgctggagtggtagagtggagggcagagggatgggtgtcaggctcttgggagtaggtggggaaagtccaccaactcaggtcatggtcagggtagggctgacacttaccagcccagcccagtgccttgaagagccaagcagaagaaaggcagacaggaaaaggcctacgctgtcctcaagggagggccctgaagacctggcaggcagaaggggtgagagtgagctcctgtcttcctgggtgctggctcagatccgcagagctcccagctcttacctgctacctccagggtgacctcagcgctgcgccccgagcaggcaggctgggatggtgaattcgacaggcatagcgtgccccatgctgctcagtggtactgggggcggctgcaagtgcccagagaggctgacagagccatcggaatggtggcgcaggccgagagccacctctgcccctcggccttctgagagcggccccctgggccaccccggagtcccactccacctccaggcccccagaagggtagaagtgggacacaaggcagagcaattcgggggtgcctcccctggggcggcccgtgcaagggttgctggcatcagggacactttgggggttctggggaaagaggacgaaatgagcatagggaaatcagtccatactgtcctccctagagaccctcagtttgcctgctggcttcctcagaactaaagaaggttaggtttcttctccgaaatagggaacccactgtctctccattggtgcgtcacagaaatacccatgtcaaagccctcaaatttccaggaaacttctagcctcccattacccctctaactcccaggaacctcttctatctctacttacttgcccaggcaccctcttatccatcatccctccccctattacggtcccacaatccagtgcccaccctctacccctggagacctctgtcccccaactcactgtaccagcaagctccagggtgacctgtccttgcaggtatggcaggtgtatggtggccagatagtgccctcctgaaagggttgaactgtaggcagccagaaggtcccatttccggtccatgggcccatggctcatcatcatcccaagcagcaaatgccacggccccttcttgggctgctggctctggccattcagcccaggagttgcagccaggagcagatgtcccttacccaggtgctgggtcgccactctagcccaaagggagggggacccggagccagagatgaggcggcctcggagtggggggcatgtaggcaaagctcaagtccagcagagcatcttgtcccagtc

SEQ ID NO: 5018 - DNA, 21044 bp, Homo sapiens
tgaaataggatggtttctgttgaaagaaaaattaaaatgtcagccaataagaacacaccggatttgatgctgagagatgtatgtgtgcctgtctgtgtgtctattggcgtgtgtttataactaagtgcctaaagcatttagagtgagcctcatttatagaagaaatgaaaaatctttaatacttttgttaaagtcatttatacttctagtgatcacagccatgataatgagaaaatcagaaatgatgagaaaaaaatctaccaatagattattgttctattcacccagccaatttgctcaaaatattcaacatacatatacaaatgttaggtaaaattgataccactgcaaatcctgaaacactttatgagttcaacaaacaaaaaatctaataaattctggaaaaataaaaaatcttggcttttaaaaacttacatgtattctaatatacatgtaaatataacaaagttctgcattctttccaactatacttgactctatcagagtgctttccaaaatgtatcgcatatacttctacaaaagaattatttgagggttaatattgcaaattggttaacatgccagactcatgccttttgcaagatgtactaaataaaaatcacttcggttggagcccagataaatgtatttaaatctcaaatgattccatgtacgttaaaattttagaaataatcttccggtatattgcagagaagcctatgtgaaaataacagttgtcaacaggcagtcattaatgtccataaaagttctattgattaatgaatgtcaatatagaaaagaataattaaatagtaaatacctaaaattacttcttatgttagtcagtataaaaagatgatatccaagaaatgagaaatatgaaaaacaaattgcacatgtaaccatattcttttctaatttttttaatttacaaaattttctaactagtcacattttccctaatttcctaagaaaaagaagtattttctattatagagtcattaagatggataaaatatgtaaatcattagacttaagtaaaaagtaattaacccctcaaattctattctttattttgataacacaaagcaaaaatcacagcatattgagaaagagaaaatactttttgttaatactggactacaatttccttcaaagtagtgcagcattaatacaatcatagcgaatgctttcctatcatttctgttataatgctaagtcatttgtagttaaatgccgatttctagaattagtaagactaaggataatctggtagaaagatctgagaaaataaaagtgatattacctgtatctgtgctatgcagtggtgcaggtggagaaaactgatttcaaaatggggagaagctggcctttcgggtcctggatcccttaggggctataacatgaaaggcagaataaattctcttcgaatgatactgtaactcaaaattttctgccccacctcttgaccaaaggataagaggaaattgtatcatgaaagctggtactgacgggaaaggaaagatagtcaaaactgcatattcctctatctcaactaaccaaccacttagtactctttgcaaaataatgttcaaatcaatatttgagggctgaaaagataaaattttgtacacatctttggagaaaataaactaatatcattaacaaaaaactaacgtactttagagaaactgctggtaaaagacattacgaaatgtctatgtataaaaatatagacatataaaagaagtgtaatgattgaactacttactcttagtttaaataacagtctctctgttggaaatgttctcctatatgtcattatttttaaaagttcctttttctatctgtttatttcaagtaaatgtattttttaaattactttaaagatccgtaattcctctataaaattgtggcatatattcttccagttttttttctctgtatttgtgcttactatcaaggttggtatcattccttacacagtattttttatttattatttttaataaataatatgtattccattatttcaaagaaattcatctgaaatgttattttaaaatattactcacagggataaaccatcatttatttaggcaatcccctactattggatacttaattgttttcaattttttctattgtaaaatatatttggtctgtactttttttttttagggaactttttaagcataaaattgtatgtcaaagggtatatgtatttaaagaactctaatattatcaccaaatgccctccagaagagatgttccctttgatgttccatcagttgtgtgtgaaatgtgcacatttgattttttaagaaaaagatactggcaaattatttctctacttgagtttcccacgaaatctcacttcataaaatctatccctaaaaccttccagcaaggcctcacatttcacctatatcgaagacttgaaaaaattcatttttgtcactccaccatgaggcagacctgccagaatgtactcagatctctcattgacttccacttttattggattcagtctttttaatcttctgattacagttctaggaaaccaacttaaattgttcaaatcaggtgatagtggtaataaggagtgtgggatagagaggcacagaacagcaggcgaaattgctgatacagggaatgtagtccctgaagtcggccacatcatcatgtgcaggccatcagatgaaacatctcccgaggctaattttactcaataatgtaggcaaagtttcatgcatggagtttggacgcttcagaatacttgctgctgggcattttcttctttccctccatcctggattggcttcgtcaatccaaatcagagtaaagacggtccatatccctttatctcaatgccaaaataataaataaagaagttagttctgtgagagatgataggaagtgggtgacagggtcaggggctggggtgtagaatagcggatgttgaaaaggtgacagagatactgtcacgtattggagtacctcttgtgctataaccatattaaaacctcccaacattgacaagtattttcgtccccattttacaaatgggaaactaaagtgaagaagttcattgacttgcataaggaaacattattgctaattcttcttcctgtttaaaatctggcctgactgaagacagagcacaatggaccgtgaattcagaagacccgggcttccaacaaggctcttgccacaaagcatgaatcctggaaccaggcaaatctgcttgaaatgctagcccctagctcccatgtgtgacttcaggcaagttacttcatttctcaagtcttgtattcaccatagtaaaatagtgatattttttgccatccaaggttgctatgaggttaaatgaggtaagatccatctcaaagtgtctaactacaacctggcatatatatggtggctctcataaaatgttaaaaattgttacttgaagtccaagattcaaattgttcttatcataaaaatttgaacaagtcaaccaaatcctcaagcctcacttttctcataggttcaataaagtatcacacgcttcataggctaggactaattaaatttagcactacagacaggatttctacacttcaaaataagtaactgttttcttgtttgtttttcttcccctaaggttctaatagggaaacaccaggactgcagtgcagaaatcctgacatgttatactgagccaggttctcttcctgccatgaggcttggcgtgctagtgccaccatcactctagagaaaccattccgtggtgcatatcttactgccccattcagatagatactggttatgttgaggcatgtttctgtttgatttacatccacatagctggggagaaggtgaatagttctcaggatggagactagacaatgcagagcacaattttttatactttttacatattgtctcctctatcataatataaagtcacaagtctgtcttattcattattgaaactgcagcacatgtaagaggcatgatgcctacagtgcacctcatgaaccaagtggatcaagttaaaaggaactgactataaaatctagatttttcatagttttgaaaagaggcagaatgaaactgacgacgggaaagccaaattttctagcgctcccctgttttctctttattaccaagctctgaattgctggaaaaggcaaatttctccttaaaggaaaacacaatcagcaccagaagataacagtaacttcaaatgagattgaaactcctacctggccttttgattaaagaggcacaaagttggaagtattaaactttatcacatcagttaataaaacagaagagaaatatacagagttttgaatgttctggtactttgccttccaattcacttttgtgcaaaacatgcacataacacacaaatatgaatatatgaagtattaattgctcatcttctggctcctttcctgcaaaagccctttttatttaggaaaccacatatttactcattcctttctgaccataccgttagctagaagcttagaacagcttctagtcacacttcaaaccttcgggtcacactgtcaaacctcagtggtttatcatttcacagcagcacacgctcttcctgccccagactaaaatgaaggatgtctggaaaaacccctagcatgcagggagatggtctgaatcacttcactgggaggactaacctcacccagacaagttgccatctcctttttatttgttctaatgcctaacttttatcccactgcatgacactgaacttcctggctctatagtaaagaaaaagataaaacgaggccgaagcaggcacaaggtcaggagatagagacattctggctaacacggtgaaactccatctctactaaaaaaaatacaaaaaattagccagcgtggtggcgggcgcctgtagtcccagctactccggaggctgaggcagggaaatggcataaccccggaggcggagcttgcagtgagccgagatcgcgccgctgcactccagcctgggtacagagggagactccgtctcaaaaaaaaaaaaaaaaaaaaaaatctctagcttgagatttctgtttccctaatcaccctgtttgtctttcttgtctttacagtaaaatacattcaaatctctaagtttaacatacattgtcccaactgaacctctagtaattgatcaaacagcaacctccttcctcttatttctgagaaaccaaacaagagggccacctcaggaactaagttaacttgatgacataatggcaaaaaaaaaaaaggattcccgatggcaatttaagagaaaatagtaagctgatctgtaattaagacttctgattcttaaattagtattctctccaccacatcaccagttcaaattaggacaaggtagatgccagagattttgagtggtagttatccaactttatgatcatcatacggaagtcagccaaggcagattctgaactcaccctcaaatccttcattacctttgttgtttattaaatttttaaaattttctattcgacttcattatccattcatgcaggaatccagttattaattaaaggggtcagtggttaaacttacagcacagtccatgctctaggttcacacatttcaaatcaaaacgaagtagtctaacaatagaatatataaatcatccagttacattaatatttacattaaaaatatccatacaaatagactcagcctgataccaagaaataccaaagataaataatctaaaggcaaataatctaaggacagagcaagacagcaacaattcaacaaacttaaaaaacacctactatatggaaaagactgtgctagggttctgcatatctcatgaatggggaagaggtgggatgaggtgcagacagtacttggaaaaagtctgatatttcaagtggtctctttattaaggaaggaggtaaaaggaacataacctgagcgcaataaaatctagtttcatataaaactagtattatacaaaattcagtttctaatgatcactgtcatcagcaacttacaatcaaataaaagacagatcaaagtataagaaaattgtagacggtatattttcctaatgacctagtctcccatcttggtttaaatatgagaaattctagtagatgtggggatagagctaaataaacgaaaacgtaaggaagttagagaacggggacaaagactaaagatttttcaacgtaagcactatttctcctcaaccttgttcagtttttaatggatcacttattcaacaggagccacaacctgttttgaggaacaaccaacaactgtgggcctactgaagttcaaaagacgattgttcctgtttctgaggttgacatctaaatgcaagaaaattacatacgatttcatactgcacaatcatcaaggtctacaactggaacagaaacattttacatcaaaagacctgaagatgatagcgtacttgcataatgaagtggaaatcatttgactttcctggcaaacctgaagacaatgggcatgcattttgaggagtgaaaaggaccatctagtgctcatggcaaacaggttaccaagccatgctctagagctatactgtccaaacggtagccgctgacacgtggctatctaaatttaatcaaaattaaatagcactacaaaaaaagtagtttatggcaccaattacaccagttaagtgaaaaaccaagatttattataatagagatattacagaaaaaagatgttaagtatagaatctaggtaggggtaggcatataggtgttcactttatattctcaagagtttttaatgttttatccttttcacgttagaaaaaaattgtttaaatagcccataaattcagttatacaaggcacacctcaagtaatcagtaggcctcatttggccagtgctaccctattggactgcacatagaacgtttccattattgcaaaaaagttattggactgccgactctagagcctacctgctcaggagtcctggcaagccttcagaaactaattattcccccaaaattcagtgctaacttgttcctagggcaagtggattataactactggaacagtgaactttttaagagtggggcttcagatggaagaataaaaggaaacaaggaacatggttacaaaagtaatgaaagaggaaatctatcagaaagaggttgaaaggaactgggaaactgaaggagactcgtggtcaataggagttaaaaatatttatgtacattcatacatacatatctgttgtctaaatgtttaacaatttataaagctgaaaactcatttagttctcccccctcccctcacaccaaatacattgtgaaataaggaataaagacataatcaaagatatgcctaacatgggtagactgtactcttgtaacactttaggacctcactgcttataactgaaaatatttaatgtgaataatccctgaggggtttgtcataactgtaaaaaaaaactagaccttgtataagcccccaaaattaaatccaatcatgtatgaaggaaataagggacaatctacacttgccttcatggatgggaatctggctacatagttccacctaaagtatcttctgtcacaggatatattaccagaacaatttcttattatctctaaagtgaattagagacatagcctcctggaaaaacaaaaaactactctgcaaccaggatttggtatgttttattagagcaaatttttaacaaaggtggctttcatttacagaatttaatgtgtgtggggactgtccaacccatgtggactcagtaaggataaccattaagcttgctaatgtattttcttattttcagtttacatacaaatttttttgtttgcttcacattcataaaaaccccaatactgtaaatgacaaataacccctccatcccttaattaaatatacaaacagcctgaaaacatacaatttaaattggtttaatcttaagtgtaatccaataagactgaaaactaaacatttcaagtcttgtaccaaatagtaaaaactcgaaggccttcaggatccctaaaatttaaaaaggtaaaagttactttttcttcctagataaaacaattctttaaatgcctaaaacaaaacaaatcaaaatctcataacaattaagtaacaaaatttaggagaaaggaaggattttgctgacaactaaaatgaacatacaattaaatcttttctatacgaaaaaatagtttcttcatcagtattcattttagtatttaaagagtcatatccttatgattgtaataaccacatcataaaaatgtctaataaagcagaaaaaaatatactgtaatgctaccatttcatagaataactataaacattttgatgtttctctatttttaataactaaaattattccttgtgcccttttttacattactttccccacagcattaaaaaaaaaaattccctagtaatttttaattaatttaataattctctccttgttagacactgggttaatttcctattataaataatacttcaatgagcatcttcatgcataataaagcttttcaatatttaggaatagttccatagaagagatgctcagaaatgaaattactaggccaaagtgaatgaaaaatgtcaacagtttttgatgcatattaccaaactgctttccaaaaaccataccaatttataatcccagtagggtatcaatgccacacccttaccaaatgtaggaaaagaatttgatagtttaaaagcatttggatggtctttgtgaacacagattttgcgtccaatagtatcatgcattcattcctttctcctttccactaacaaatatttattgaaagcatctatttgtgcagggcactatgctaactctgtggatacagcaaggttctcaaggagcttacattcaaccagtaaagcagacaaataggttattacaattcagggtgacagaaaaaagtaagagcctatggggacactttgaggggaatgggcacaaataaaaataagtggctaggatcagaccagaaaatgggatgtgctacaaaaccctggggcagaggagagacagatcttgggaagacacgatagctaaagcatacttaggccataatggattttttccatctttttcccaagtattggcccaagaaggacagtgagatgatataggcctaatgaggctgacataatccaataaggattctttcctttggatttgctgatactgtatccacatttttatacaaagtagctaatacacttgggcattattatatacagctgttggattaaaagtttttggacaatcaatgaaatacctgctaacttctactgagagacaagataataagcctttaatgacataaaaatcaggattcatctgcataataaactgataggatgccactgaaattatcttggctagcaaactgactaagttctaaaatgagcctctgtaataatgaaaacttcgccaaaatgctttaacatacttatttgactgatttacatcaataagagaacctatttttgatgtggtaaaagatatgtgctctctccaattacaatttcaagctcctaaaaaatatagcagaaaaatgtagttaatataaaatctatcccagaggtatctgtattcttgctacaagcagatcccaattttagttgcaagtttctagcagccaacagagggagtggggggcgagggggaaagaaacatggtttcttagattaaactatatccttaaaataaagactgctcacgcgcactacccccaagtttaggaccaaaaagaattgctttccagagacataaagaagacactatgaaacaaaatgacaaagaaatattcttacaatgtcagtaaaaactaaagacatcactttgaagcacatgttgtaaaaatgatggagtataagaccatttttaatatgataaatacacattttttctttctggaagattctcaaataaaatgtgtaatattaataaccaccaccactttagcacctactgtatgtcaggcctagtggtagggactttgtactctctgtaatcttgaaaataaccttactaacctattttcaaatgtgtaatccaaaactcatagagcagaagaaaatacttgttgatatttataaccataataatgatggtacttatatttgatcccaagatggtaagacttcaaaactaatactcccaaaataactaaaattaagaactagtaaaaaaaaaaaaaaaaaaccaacctaatgtagagttcctagtgtgctgtaattactgtatagatttttccctatattgtttatctgcaggccaaaaccaataattaaaaagctatatctgtaatgaatcttcaagttaacagacactattgagacaatcctagctatttatttaatcagaggcctaattatgcagtttatgacacacacaaatggagaattagctaagatgctctaacagccataaaacctttgacttgatacaaaaggaatttctgaagcatgcctactcctccccactaaccaaaacccatgaacacatccttaaggaatagataaaatactaggctctccctgagtctaaatgatataaaaggttagctgctgtgtttgctttttagtacatatgtgtatctgcataaaacaaactgaggcctaaatttacttttaaaagtgatacgatgcttaaaataaatactgttaactattacctttgcttttctaaaaatgcttctttaagcagaagacttaagttactcctacagagtgtcagcatgtgttagattctccacattttcttctattcaaagaaggtgatacaaagtacaatcctcagggatatacaaagtgaaattaaatgtttcttccttccaggggttgttgaaggaatttctccaagagttaaaagacccaattcagaaaccaaactttctttttacagagtgaaattaggccttcagagtcttcagaagcctgagaaacatcatttattctgaaggaatatgagagggaaatgcaatctcagttttaacaaagaaaccaccaatcaagtttctctctggggtatagggatgcaaatagaattttagaagttatgatttggcaaaaataaattttacatagtcatattcttaataaagtgattaacacacaacagaaattattcataacactgcattgtgaaaacatcctaacgttgctggggtgactacagagaaagatgtctaaatttagagctatgcactgactccttcactctaggaggtagcacagaaaaacagaactaagagataaaattaaagagaatttaccaggtcctattaaatagaaagccaaagaatcaacttagactcattccaaataaataacgggaaaaaaatagtattatcaatttttaatatttatacacttaaagaatcactaaatacaaaccttcggccaaccctatcagggggaggccacaaagcatcatcttcttttgtaatttcactgtatcaataattctcttcagttcttccattacactcttgtgcacataagcctaaaaattaacataataaaatgagataatgcccacctatgtcacccctcaactcagaaagaaatgagttcaaaccctgaatatccaaatagaggaatatagaaaaatttaattgattccaaaagtagagagacagaatcacttatccttgttacactgcttttcttcatctcttgccctttcctttccatacattttttccctcttctcatcattacctgtctttcaaacactgtattctgcctttcaacactgagatccaaatacccacaagtggttaacttgtgtcatcacaagatctataagtgaactgtaataaatgcaagtatactgaggcaggagaatcgcttgagcctgggaggcagggttgcagtgagctgagatcaagccactgcactccagcttgggtaacagagcgagactcgtccctaaatcaataaatcaataaatgcaagtgtagttcacgtcaaggttagttctctgactttctcattcctatggatgcaaacactgtatctaatttaaatggaaactctttcaattataaattgccttcttctttacaatatagccttagatgtacttttttaaattcaacacaacttgaagaaaatgggctaaatgcaaaaaaaaaaaaaaaaaaaaaaaagacattcacatgaacttacctcttttctgatcatgacatcatttttgtaattgctgttgttggcatatctagctttcctgtgggaagtggaaaaaaatcaatttataatagcaaaaactgctaaaaaaataacatcatatacaattttgaaggtaaagaccattttatactactatttttattaatattcctccctccttgtgtaagatcattgctagacatgtagacaataaatgtttgctggttagtttgctgaagttgaagctagccaaatatttaaacagcccatgcctacaatatatattggtcatttttaaggcctattttcttaagctacatcatgaactagaaagagaatctgcaaaggcactaagattcctttaaagtttgttatatgtctgtatcggtgctaagtgcctcacccgagcatttaatctaatctgtaaaacaatcccaaaaatcgggttttattctctcacctatcataggagagaaaacaaagttaagtaacttaaccagggtcacacaagattcagatctagtctactttctttcaatactcaggctttccccactacaccaaaatgttctcttttaaaaattttttccttcaaatgtatgcatgcaattataatgcagacattttagaattatgactagaagcatacaaacgatgcttctggatcaaagttgatgagtttgttagctagtttatatttattttaatccatcatgattgctgtattatctgatgtatgcttccccttatggctagtcattgcccagacacagctataatgtgcaacaggtactctaaaatgatagaaatgacagtcttgatggcttggcaccaggcacagtggctcatgcctgtaatcccagcaatttgggaggctagatgggtggatcacctgaggtcagcagttagagaccagcctggccaacatggagaaacccgtctctactaaaaatacgaaaaaatagccaggcatggtggcccatgcctgcaatcccgctactcgggaggatgaggcaggagaatcgcttcaatccacgaggcggaggttgcagtggccgagatcgcaccactgcactgcagcctggacgacagagcaagactctgtctcaaaaaaaaaaaaaaaaaaaaaaaaaaagaaaagaaacgcgtcttcgggaggctcaatatcaccatggaagtatgtgtaacagtgtagtggcagatacattgattagaaccactgttctagcataaacttccctgataatattcaggtacttaattcatgtgacctgctaaaagtgatagggaaagcttgatggtgttcgcaggcagaggaactgaaaataatactacataaagaatagatgattcaggtaaatttagctgaatttatggggacggtaaggttaaatacagtgattaaggttctaaataattgcagggctggcccggtggctcatgcttgtaatcccaggactgtgggtgctgacgctggtggatcccttgacctcaggggtttgaagccagcctgggcaacatggggaacccatctctacaaaaaataacataacataacataacataacataacataacataacatacataacataacataattagctgggtgaggtggcgtgggcctgtattcccagcacctcgcaggctgaggtgagggatcacttgcactagggaggcggaggttgcagtgagctgagatctgccactgcactcagatctgggtgacagagtgagaccttgtttcaaaataataataatattgcaggactgtggttaacgtgagttctgcctgaaatgcttgatactcttctcctttccaatatacgttccttctctaattttttattcttgctctcacagaacattgtccaaagcctcttataggacttaatatgcatactgctttatagttaaatgtctgtgcctcccaccaagaaaatctgctttagttaaatttgtcttactcattactgtaccttaaaattttgtatttgctgttgtccagcacaaaacgtgcattcaaaaaaacccaaaaaatatatatccaaatgaacttcttgttgcaggtaggcaagatcaatgtaacattctctaaggatagcgctgtcagaaacacactgttgcacactacttgggtagcagtttcacctcatcctctgctcatactgctctgaagtctgtttttttctctcaaaggccaagtctctcatttcgagactcatctcaagagtccgtcctctaagaagatcttcctgactccctcctgtggaactttacctctcccctcttgttggtactcttcatgcgtcctatggtgaacaattacacgtaaacacctaaaacatattatattctcatttgttaacacgttgggctcctccccttcaaagaaaacacacagcctaaataaaaaaaggtactggtcaccacaagattttattcatccactggaccacccgctggtggggtgttttcaaaaaagtgctagcattttcaatcagggcgacgatctagagtcccttctgggcactgttacagaattctgattactgtaggttcaacttttcagtttgtgacaggattagtttaatttattgcaattaattctctttcatttataaaaccaacttatgcctcctctattttaagctcctatttccttcgagggaagcagtggcctccgccgcctgtaccctccacacccccggcctctcggtctcgctcccctttcccagcaccgcgtgccgtgggcctcttctcacgtccggccgaaattcgaactccagaaactcgtgcccaaacttgcccttgtgccctacgtgtagcgcaggtagaaatcgctagccacagccatttttgtacccgggaagcccgccgaaacgcagccaacgtgtcccccggcgccttgcagtgacgtcatcgcgcggaataagtgcgtcccacaggcgcttctcttcctcctgcagtgcagccctagactaaagcgtgaaagccgagttcgcgtgagagtccggaggcgctgaagggagggtcgcagcgccgtgactttcgctttacaggaatggaggcacattgttttcaaaataaagattacattatactagcaaagattagaatgtgagcatatgatagtcttttttatggacttagagctaaaggtttgcaagtcacttttcttttctggtctcccaatccttgcggcgtttgtgaggtgggtgtggctctatgcccccttaactgtgagctaaataaagataaagcttagaatcgaaatggcagaccgggaatataaatatttttcttacttaatttctaacagggtgctttccctttggatagcgattggtagttaccgggacctctaagcctataataatagagacaaagtcaaaggaatccaactcttaaaacctcacaccccccacacctgaaaaaccctgacagtcaccgtgctttttttaacagcagaattctaaggttcttaattcattcaataagggttaacttttagtagcctgtgaagttttggaatttgacttacgatacaataatggtttagcccattattgtttctcgccagatagaattaattgggggaatgaaagaatgctccagtgtggcgtagtttttaaggtaagggaaagactttacacaaagtttccttttcagatattattgatcacccttttgttatcaacacacagagaatcctatctgtcggttgacaaccttcagtgatttttagtagaaagtggtggagagaagcctgggattcaatcccaacacttaacagctaactaacctcgggcaagtgactatctctagcctgtttgttcatcagcctaatgcatatacagcaatctacattgccaagctcacagaatcttgagagatccaatgagataatatgtaaaataagctttaaattttataaaacattagtttaacaaacatttcctatgtgacagtttgaaactagaaataagccatttgatctggtatctagaaaagaaagcaaacacgtaaggcgaataccagcacaagggagcaattgctataataagaatatatgtgccatcctggccagcatggtgaaaccccgtctctattaaaaatacaaaaaattagctgggcgtggtggcgcgtgcctgtaataccagatacgcgggaggctgaggaggagaattgcttgaaccctggaggcagaggtttcagtgagctgagatcgtgccactgcttccagcctgggcaacaagagcgaaactctgtctcaaaaaaaaaaaaaaaaaaaaagaaaagaaaagaaagcctatatgtggccgggcgcagtggctcatgcctgtaatcccagcacttgggaggccaaagggggcaaatcacccgaggtcaggagttcaagaccagcctggccaactggcaaaaccttgtctttactaaaaatacaaaaattagccaggtttggtggcacgtgccgtaatcctagctactcaggaggctgaggcaggagaatcgcttgaacccgagaggcggagtcgcgcagttgcactccagcctgggtgacaagagcgaaacttcgtctaaaaaaaaaaaatgtgtaaaacatgccggtagtacagcagaggaagcaagagcattctattgcagagtaggaaatttgaaaaaagagtattggaaaaggcttgtcaacggaagtgtttgaattggaccttagaagtaagttctgtgtatgttcagtgggatgaaaaagcattccaggcagaaaatgaccgagcaaagacagtggtgtgaaaattcatgtttggggaacactaagaaattcggtatagcagagcataaggttcaagtagaatgactaaaaaggcaaattgggccatgtttccttgagtcatattagtagttatataactattaatatagaaaaatgaatcagtccctacaatgggccccattttggaaagtacgtaagaaacaggaagcaccatgttttaccactagggtgactagcgttccagtttgaccaggactgtggagtttcctgggaaatgggactttccatacctggaacacccaggcaaactgagatgggttggtcaccacacttaccacaagaataattcacagaatttgaacactctattccgtagtatctctggaaatatcagctgtaatccattttgttgattatatggaaagcctcattcaatatcttagattccctaatgtctctccttcaggtttttgcacatgtgccaatgttcatcttcatgtttacctaaatagaactatggataccagaatggtaactatataaatagaggttacagaatgcacaaagtattaacatctttgttaagtgggcagttactgtcttgatctccaaaaatgacataggggttcaagactataatcctacctgttgtaagataaaatatgaaactatatttacttaactctctatattttaagccaaaatttgaccttttgtattgaagcaagaattacaaagtgataaagcatttgcgttgtgttgtattctggatggtacacaacagtgatgtggaaatgttcttctgtatggctgctgagcccttgaatgtgactactgtgacttcgaactgaattcttaattgtgattaatttagattaacatttaataaacacatgtggctagaagctactgtgttggtcagcacagttagaatcttttcataccttttagttgggctagaaatagcaaaaaaaaaattgtgaacattttcaaattgcttgtttaggctccaaattaggacgtacttactgatatcaacacagtttacttatgaaaataaattttgagctgcttaagtgaagccaaaatactgtttccacctttgctaacacagcggtaaattcaaagcacaaagtgaagtaggtaagaaataaacgttttatttccatctgaaattaggcttaatgatcaaatcattctgacttccaattttcagaaacatgttccatgtttattgtgtaagcactaggtattatagtctcatgtttttaatttatgaataacgtctgattcatttgttttgtatttacagaagaaaagatgtcagggctatctcattcagttattaataaatggacagagtagtaagtcaagaataagtgcataatgtggtttaaattttaaaaaatactcagatgaggtagtattttaatttttaattcatccacccaccttgctcttctcttttccataatgacttccctgtggacgttagccttatctgtctttttaccacttagtggtattaacttttaagtaagagaatcatgatcatgcagaaacaccaaactttccacaccattcgttatcacaatgttcatatatggcgagaacttggagctacttctagattaccatgacatgatatatttattcgattgttcaatctaaaatttttttccagcaaatgacaatattatatgcttcaaaccatagcataatctctaactcttttccccaaaacgggtaaacacagtatgctaaattaaggtaataggatatcttccagtcttccactgtatttgctacttatttatttcagtaagagtttaaagcaaaatttaaaaaaattattgcaacagagttaagattaagaaatcttaattaatgactttttttgttttaaaatgctaaaaaaaaacccactactattatttgattttaatacagaatacctaaatctggcataaaaaaacatagtgtgctccataagcataatttaagaatactggttcagactattctattttaaacgacgttaccaagtttcccttagacactgtattaggtgggtgtttgcgttgttcctaagtgttggaatttttttttaacaataaagcatagttggaaaaacaagactggaagagaaggcaatcaaaacaatacaacaaaatctatctagatcaacccgattaaatgataaatattttgattctttttttcattcattagcttggaaacactagtttggctgaaaggtcaatgatgccagaaatatcatcctccttctggaagaagcctgccaagtgagagaaagacccagttttcttagagtaaaaattactgtatccagttttccggccggaaaaacaaataaaattgggggtaaaaaacttaaatatcaattgtctgcttctttcctcctactaaaagaaatatgacagtacaacaaagcaaccttccatttcactgtgttccctttcccttagctcaccgtgctgcaacccatatgctttcttgcagttccttgcctcagattttcacgcacacatgtcctcctcctgggagactcttcttattcggcctgggttacttaccatccctaaggtctcagtttatagcccatttctgttcagggaagtgttccttttaaaccccttctactaccctatgctttttctttatagcacttaacacttcgcacttaacagataccacacaaataaatgtataatgtgtctcaccttctagactgtaatcaaaagctccctattcttttatcctacacctagccaagtgtctggcacagcaagccttaacactcaatattttcagtgatcagataaataagtaaatatttgtaattttgacttaactgaacagctgagaggaacaatgggattccataggactttgtaattttgtgtgaagccactcttctgcccttctcctactgcaacttgctacccatttaaatcctgactagtcattgtggtattcttacagcggaagaatcattattcctttagctgactcattatgattccatcaggattccaacttctacacatttttagctgccagtcatttttcttatggcagccttagatgtcccttccagggtaccaaagtgttttttaaaattgcagactaccatgttcaacagaattgccctcatgatgatgtttcaatattttgtaatagtaggagtccactatcatcatccaaaagcgtacaaaaatgatacttcatcattgcacatgtataatatcactacttgtgccatatcatcatctttaggcattcctgccttgcagtgttagcgactgagtttctcttcttggtcacagtagattttaaatgaaaatatatgaaaggtcctgggttaggaagggcaaaagaaaaggagaaacacgtttattagcgcatatgtgccagatagtgtacaaatacatactcaaaacgtatcaatcctcagaacaccttgtgaaataggtattatccccatttacacataaagaatcccttttctgacattgtcattatctcttgaatttttctattggcattaactttcacttatttacttttatcctcccatgatatttttagtagttataaaccagaaaagcatatttccatttaataaatattaattaataaaataagtttcacagtatatcaacagatgattgaaaattagaagctgctatccttcatatcagattacattcttttctagcccttgttaaagactgagctactaagccttcttgttggtttctacatttcctatttattgtgcacacacacacacacacacacacacagaattttttcactgttctaacattgactctctaggcttagtctccttagtctaatcggaactagaagctagcttaatgaacaatacatgttgaatgttcttaatcatgaaatgactcctccacttctaattaaacgtagtaacaaacagaatttacctgtctcagaatcagataaaaggggacatctttcttttatctatacctaaggtgaaactcagaggt

SEQ ID NO: 5019 - DNA, 26263 bp, Homo sapiens
tcccagcactttgggaggccaaagtgggtggatcacctgagggcaagagtttgagaccacctggccaacatggtgaaaccctgtctctactaaaaattccaaaattagctggatgtggagcatgcctgtagtcccagctactcgggatgctgaggctggagaattgcttgaacccagagggagaggttgcagtgagccgagtttgcgccactgcactccagcctgggcaacagagaagactttgcctcaaaaaaaaaaaaaaggcatagatctagtagccttctatagtacaagagggggtcctactcctgataccacctcaggtgcgcaattttttttttttttgagacgggtcttgctctgtcacccaggctggagtacagtggtgcaatctcagctcactgcaacctctgctcccgagttcaagcgcttctcctgcctcagcctccctagtagctgagactacaggcgccaccaccacgcctggctaatttttgtatttttagtagagacggggtttctccatgttggcaggctggtctcaaactcctgacctcagggtgatccgtctgctttggcctcccaaagtgtgggattacaggcatgagccactgtgcctggccttttacttccttttattcctgctctaaacttgtctctgtctctctctctctgccttttgccccttagttgaattcttctgaggagcaatatatatatatatatatttttgagacagagtctcactctgtcacccaggctggagtcagtggcatgatcttggctcactgcaacctccacctcctgggttcaagcgattctcctgctcagcctcccaagtagctgggactacaaacgcatgctaccacgcctggctaatttttaatttttgtagaggtggggtctcgacatgttggccaggctagtcttgaactcctgacctcggtgattcacctgccttggccccccaaagtgctgggattacaggcgtgagccaccacgccagccaagaattgaggtgctgtagactcgtacagatttgtggctacaaacaattttatcagagttcctaaaagcgtatatctgggaccaggtgcagtggcttatgcctgtaataccagactctgggaggccgaggtgtgaggactgcttgagcccaggagttcgaaccagcttgggcacatcgcaaaagaccccatctctacaaaaaaataaaaaaattagtggggcatggtggcaatgcctctagttccagttacttgggtggctgaggtaggagtatcccttgagcctgggagtcgaggctgcagtgacccatgattgtgccactgtactccagactgggcaatggaacgagccctgtctcataaaaaaaaaaaaaaaccaaaaaaaaaacatagatctagcagcttcttaagtacaaggtggggggtacaagttcagaaggcaagaactcaagagactttctttctttctttttttttttttttttgagacggagtttcgcttttgttgcccaggctggagtgcaatgcacaatatcggctcaccacaacttacgcctcccgggttcaagcgattctcctgcctcacttcctgaatagctgggattacaggcatgcaccaccatgcccggctaattttgtatttttgtagagatgcggtttctccatgttggtcaggctggtcttgaactcccaacctcaggtgaccactcacctcggccttccaaagtgctaggattacaggcgtgagccaccgtgcccggccagactttcatttcagagtagcaatcggttgagtgccttggcttgtgccaggcatgaatcgtcaaaaataaaatcagatcaagttaaaatttcaggagttgattgtgcatacaaaggaaagtctgtgaatcgggagattacaagattggcaagaagtctgaattgacagcagttgtagacaagaggaagtattttgaccctttacatgattggctgatatatattttttcaaaggcaatagagctgcttaagctggtttgtctatggctgattggtttaattctgtggaatcatgcaataagggaagaaaacttattcttgtgctttgtttatgtttagagttagcattttggaaatcaggtgctaaaattttggttatgtggctatggtggttggtctcggagtatctaaacattgtttcagctctttatcaattctaatgactttattatatgcattaccaccttctcctctcttcttcatgcggttttattaccttctttaatcctcacgtctgccctctgaaatagaactattccaggccaggtgcggttgttcacacctgtaatcccagcactttgggaggccaagcaggtggatcacttgaggccagaagttcaagaccaggctggccaacatggagaaacccttctctactaaaaatacaaaaattagccaggcatggtggtgcatgcctataatcccagcttctgggaggctgagacacgagaattgcttgaacccaggaggcagaggctgaagtgagccagatcatgccactgcactccagcctgggcaagagtgagactctgtctcaaaaaataaatagtaaaataaagtattccagtcatgtgctacataacatttcagccaatgacgaaccacaacacgatgatggtcccgtgagattataatattggctgggtgcaggggcttaggcctgtatcccaggactttggaaggtcaaggcgggaggaccgcttgaggccacaagttagaggccacctggacaacatagtgagaatctgtctccacaataaataaataaataaataaataaataaattttgtgtgtgtgtgtgtgtgtgtgtgtgtgtgtatatatatatatattttttttttagactggatctcactctgtcacccaggctagagtgcagtggtgcgatctcggctcactgaacctctgcctcccgggttcaagcgagtctcctgcctcggccttccgaatagctgggatacaggtgcgccccaccatgcccagctaatttttgtatttttagtagagacagggtttttcatgttggtcaggctggtctcgaactcctggcctcaagtgatccacccacctcagcctccaaagtgctggaattacaggcatgggccactaggctggccaatactgtgtttatactgttctgtgtttagatacgcaaatacttaccattgtgttcaactgtctacagtattcagtaagtaacatgctgtagaggtttgtagtgtaggagctatcagctataccatatagcctaggttatagcaggctatccccatctaggtttgtgtaagtacactctgtgatctctgcacaatgcaaaatcgcttaatgatgcatttttcagaacgcatccctgtcattaagtgactcatgacgtatctctatttcacaactgaggaaactgaaactcagcgaagtacatcacttgcccaagccacacagtgggtaaatgggactaggcatgggatgcaggcagcctgtcttagatcccacctcggatcccataccctgcctccagggtctcagactttacgttttactgaaaagacagctaattcatgagcagctggatctcagaaagggagccaagctccttggtacacagatggccaaccacgaatggtatctgaagggctcaataacaggagccagccgggtatcttcttcacctctggggtgaccaaagacacgaaggactgagagaaagcctttagaggcctcccccaaaattaatccgtttttgtgattgtttctcctggactagactgccttgaggataaaataaacagagcgcctggtggcagtgcaatacctgagtggtacgtgggctctgcaggccaactgcctgagggaggaagccccatcaccactacttgtgtttctgttccccatttgcaccacacccccctttgagggtaactgaagcctctgagttgtcaagatccttaaaagatgacagtttgaggagagaatagtagaattagaaaccccaagaggccaggtgtggtggctcacacctgtaatccagcactttgggaggccgcggaccccgaggtcaggagatcgagatcatcctggccaactggtgaaactcggtctctaataaaaataaaaaaaactagttgggtgtggtggcgcgcgctgtagtcccagctactcaggaggctgaggcagcagaatcgcctaaacccgggaggtggagttgccatgagccgagattgcaccactgcactccagcctggcgacagagcaagactctgctccaaaaaagacagaaaaaaaaaaaaaaagaaacaccttggacaggaaacatgtctatggaggaagtaaggccagatgcttgcaaaataggggggaaagtgagaccgggagggaacattccaaaagttacccccatggggtctgaatttggggcctgggaaggaatttgggtgcattagatccaccactgatagtctctattttggcaccctgttttgttcccgtatagcacttacactgttctaactaaacaattaatttcattatgggttgtgcaaagtctatgattctcatcgggaccccaggtgtgttttttgttcatgtagcacaaagctcattgcctaagtagtaggaggattggtagataaaatacaagaagtccagttgtttaaattttaataaacaatgcattttttttttagtataagtgggtcccatttgcttatctgaaattcaaatataactgggctttcctattttatctgccaaatctgacaaccctggtagcagggacttgatacatttttttcttttagggagaatttctaaatcgaccagtatttatggaaaatgcataagcgtttttttgtttttttgtttttgccttgactctgccctacacttgcggtgcgaccctttggcaaaattagtccctttctatgcctcagtttccccatcggaaaaatgggagtttgaacagcgaccgagcgcagggatcgccagtgtgggagagcgccaggtgaactgtgaaggagcagggagggagtcgggccgtgcccgtgcgggacaaccccggtatccactctgggcaccgccggcggcgaccccgccagcgcctagggtgcctcggtcccgcccctacgcagcggaggccggccagaggcgtcgccatggagacgcgagcagcctggcacccactcgctctcaaagccacgcgtttccgtgcgttggagccttctcattggacggccgtctggacgctaccacccgccccgagcccgcaaggggagggggcggggccttattctcatgggattcgttccctggagacctgtgtccgcgcctctctgggaaagcatgggtcctctccctcacgcggggaaaaggactgcgtctcttagtctggagagtgtccattgcttctcctactagaatttatgctcatgctgctccctgagaaagaagagggggcgggaaagtcggccacgccccctccagagcctatttggtctcaggagtagagcaccggaagtgctggcgacatgtcagtgcgccctaccctaaaccttccccccccggccacctttcccattcagctgtgggattccggggccgcctgggcgctgcacccgccactccgcatcgaaccgccgcttcaaccgaactcactccctctgcgcgcgctccatctggtgccgactgctgggccggcgcctgggagaagccacgccctttcccgcgcctgacagccaatagcgggcgcctcccggcggggtggtgggtaattaatgagggccgggcgctgattggctgagcgtcgtggccgggggcagggcggcggggtaggttgttcctgaggtgggaggcggtaccgtggctgagaagaaggaggcctgagagcgacatgtccccggcggctcaggcggagcggccgtggcgctgtttttctgagtccggggtggcctggcagccggccgaggacgagggtcgcgggggctgcccccgtggtggtggccgccatgctgggagcctgggcggttgagggaaccctgtggcgctcctgcgactgctgctgctgctgctgccgccggcgatccggggacccgggtcggcgtggccggcgtggccggcgcggcgggggccgggctgcccgagagcgtcatttggcggtcaacgcgggtggagaggcgcatgtggacgtgcacgggatccacttccgcaaggacctttggaaggccgggtgggccgaggtgagagtccccctgccgagccgcgggatccagggctgctgtgctgggcgcagccggccgggggctgcgggccccgagcccctttcgaccctgggccgcgtctctggagcgaagtttctctctgcagcttcttcgggggcccgctctgagctcgggcctggcactggctccaaggtacctagagtcatacaggcagagagttggccagaagtagttatatttggatttctcatcctgcattttctcaacccctcactcccatccaagctggagagaaatgacgaaggcggccttttgctacctccaggcctcgcgggttgtaggtcatggtgcccctgcttctcctgtcgagacagttcttgggagattctcgtcgacccaggaatcggcgctttccttgccccttctgcaggagcggggcttgattcttagccagaataggaaggaacttcgaagagaatgggccaggaaagtttgattgtagcctcctcccccgccctcttttcggcgaagaatatgtgtgcttaaaagtagaatcggcaggccgcccccagagggtggttctacgaagccatcctgcacgtgaggctggtggctgtgtgtgaactgggtcaaccagtgtaagatccgaatggtctatcagagaatgcttacaacctcccctaggtgatcctgagagttctattccagcttagggggaaaatgattgtgacttaacttgctgggcaacagtggtttttaacgagctgctcccttcccaaagttagtgtgtgtcagaattgccagggcagctggttaaaaagcagattcctagtccccactcgaaattgattatagtagattgagcttttttgctgggatcaggtttctgcaccaggggcttgtgatgtaggttgccccgagaccaccgttttggaagacagctttataatctttgtttcttctgttggagggattggaaaacaggtttcagaaggaattctttgctaggagattgatactgtatgctgggttcagaggctaccaaattggcagtatccacctccagacaaccaggagacagactcactcttcactttctctcattctttttctgcatgcccagatttggctcttgcttttactaaaatagttagttcttcccaagtcgattgcatgtcctggagtttgttatattaaggagtttattgcctttcacacatgtgagggtcttggacacagggctgttttgtgaagttctatgtttgtcttggagtttgttgagccctggcatgagatcacagtagcctgggttcagctgactcagggctccagtctttagcagcggtaacagagccaaagccagactttatagcaggaggtcattactatctctatcctggacccttcctcttcttcacgagtgtgggcagggaggaaagagcccttgaggaaactagacagtttgtggatttgcctcttgagatagcggtggtgagggtgctgagcggatggtttctttcacttagcaataccaggccttacattggttacatcgtcctattcagtctgttgtgcagagaataaagcgagtaagaccacacaggtttagttcccagatactgcccttattcagaaattctggttttatttgctgatgcaggtggtgtgtgtgtgtgtgtgtgtgtgtgtgtttctttggcttggtagcagtcagccaagatctgtgtccttgggttattggctcatggttgcagttccttggaagagtttattgtagcaggtaaaattacatgagacctaccaaagcttgtgtgtactggagtctatttcggacactggcccttggggcattgtataaatgaaggttccctgctaaggttccctctccattctaccaatctgggtaagaattggagcagtattaaggcatggatggggagtggaggtggcgcttgtcagctgcagtttggaccagcttgttgcaacattgcgcttaccagttcctgagaaaggcattttgctggctttaggtcgggctgagatgcgcataagcttgcacctcaggaggcagctctctactaaggagtcagtcctaccaagggaagtccagctgttcacctgcctttcttctgggcctgtttggataagggtgtgccaggtatttgaagacccttgcccgtgcagctatttacactgattgcagtaggaactgtatgccttatttcttttcccgcctcctgtgatattgtttccagcatgctgagaaaagttgattttatgttgaatgaattcaggatttgttaccaagttagtccagataagggtttggccttcttttgaacttgctgtttctggtagtttctttgtagttcaacattcttgtaattgtgagtggcccagggcacctagtggttatgctttcaaaagcagttcagaatatttattgaatttcatttctgccttgaggatagcagtgcttacagcctgggaaaggctttttcagcctgtgtgcttccacagatgggagcaccctacagaaagtggtttagaagcgttcaccttggggttttggtatgaggcacattccaggtttttatttatttattgaaaatttttaattttttttttattgtagacacaggggtctcatatgttgcccaggctggtcttgaacttctgtcctcaagtgatcttcccaccttggcctccaaactgctgggattacaggcatgaaccatcacgcctgaccatgttccagatttgtaactggtcattttgagttcctcttcactctgactaggaaaagacctggttatttgacctgaggcacagaattttgcttgagtttagggaaggctatttcctcttcagagaaagatacctgcaaagtcgcaggtcctcgagaaacttgctttacgtctctgagccttgttttccttttcaaaaatctctcatgctttagaaatttctgataagactgtaaactctcctgtccagagtagctgaagtgtctctgtcactttttttttccttgatgaccttttacatggaattaaaaataggcagaacatagctccagaggggaaaaaagttggttggggaccagagcctatcaggttgcaatgctgtaaccttaaggaataccctttcctgggctgccttcctttcacctggggaaggtttggctttggggaggtaagagcttgaaacatgggatgagagaggagtcactgctaccttgatttgctcaaagccatgggagttgtttagaattctctacctctactgtcacctaacagcaggcttcatctgcaggccttccaaatagtggaagttcacaggtagaaaatttaggtcctgaatccgtgggttcgctgtctcagcccattcagaacaattctttaggtactggcctcctggagaaagaagtgatccagaagaacagtctagtgaccaggagatctgagggtagggtggagtgacgctagagcaccaaggggggctttacagctgtgttctcatggaggacaggctctgctcattctggctttcccactcttgtggttcccagttgcagttttccagttagttttttacttccttttcttttgatccattccctaaactgccttgagtggaggcatttgtttaggcttatcgtgtgcatatccttgcctggctagcatacccatgtttctgtgtctctctccggtgaggcattgtattgagctatttatacagattgttttatccttaccacaatgctgtggataggtggtgtccccattttataggtgagaaaacagacctagagaaaacaacttgttcatgacacttcgtgtatgtcttttcctgaaccctgtgctgaattttccaaggagcctagttctacattgtctaaaactaagaaagagcagacataatgtaggcccttcggcccccttccttttggttaactgagttatgccaatttcagcagtatgctgactgtacacttcattgtatttagagaaatctgtttcgctgtgaatgcataaaggctaaggagggaggaacaacccttgttgctgctgcatctcttgggacttgggcaaattcaactttgcacgtggcagatctcttggaaagccacttgggttttaaagggaaatattttaaaggtaattccaaggttgttaagtaattttgttcacatggttgagttttcttcactgtgggactgagactgccgcagattacgttctgtcagttcctcactttttccacttggcaagaaaaaaaaaaagattcggcctggtgtgtggctcacgcctataatcctagcactttgggaggccgatgcgggcagatcacctgaggtggagttggagaccagcttggctaacatagtgaaagcccgtttctactaaaaatacaaaaattagccgggcgtggtgatgcgtgcctgtaatcccagctacttgggaggctgaggcagggaatcgcttgaccctgggaggtggaggttgcagtgagctgagattgcgccattgcactcagcttgggcaacaagagcgaaactccgtctccaaaaaacaaaaacaaaaacaaaaaaacattccccacccatgcacaaaattttctgtgtatccgtaaatcaaatgtagtcgatgttcagatttgtaatgatcacagtcctcatggaagaaggaaattcttagagctcagttggaaggaaacagcagtctttcagtcttcataggtttgtatcccggggcaatggttttttgaggcggaaaggagggggagcatgttagcagtacatcctttgtatgcattgctcagctactcttgatttcttgaggagaaatagaaagaaaaaagtctgaagacaaaagtgcaatgagtttcccttccattgtctcatcagtccctctgatctcgtggctaatgtcacttacaggaactgttacagttatgtttatttttttgaggtcttgacctcaaccactgggtctttttgttaatctttaccttttgccatgtcttctcccttgttgatgattcagaagataaagctctggggatgcagcccctggccttctcccaaaggatctagttgccagatgtcttcagggtcaccacgtggattggaaggcagtcttgaaatcttaatttcatgcgggaggagagactacatgacggctcatctgtagttggaacagtatatttatggagcactggaaagccttactgtgtttataggtaaaggagtcaggctactctctggaggaagcagaactatttacctctgagactgaaatggatatcttatatttgcacaaaaaagattcggcctggcgcggtggctcacgcctgtaatctagcactttgggaggccgatgcgggtggatcacctgcggtcaggagtttagtgtgttgtcgagaggaagaaaaaaacatatatacaactgtcttacaccaaggttgggagagggccaggccaagagaggttttctgctcttctgatactgacccgaggtaagtaactttttactttttcctctctcattccttgtcagtttgtgaaatgtgaaaggtgattcccctaggacttggaatcttaggcagattgccttgccctgcaggatgctccagccttgtggacagagtggcatgcttcactgctttgcaggcacctccttcattgtcatttattcattcagcaaactgtatgatggcgactatgtgccaggtcccgtgctaggcactggaggtgcagtggtgacttttttttctgctgttggtttatctgagtgaatgttcaagtaagtaggtgaggtggagttttgtgagctgtgggaaggaaggaaattagcatcacacctttcttttatgagcctgtttttgtttacgctttggaactttttgaatgaaaattataaaaaaaacacacaacaactaaagctggaatttattcgtaaggacaatgaagaatgactttccaaagcagatatcctgtttgttttagacctgggcttttctgaatgagagaaaacattctttgaacttcatcttgtatggagttcctgccatcccccttgttttaggaggtttctctgaagccctccctcttggggaaccaggcagcgcaacacagcactttcttctggtaatgagttagacttgttctccgtacagtcagggggaaaagtcattttaatgtgcttttagaaagttccgctctgaggtttacaggggctgttggctgattagtgtttagtttctttcattttactcttccatagtaatggctgtatgattcctgctttgttggagctctgtttggagccaggtgcagagtgggtggccccttttatggagaggttattagcattgccctggaaatgcctctggctgttctggggtctttgcttttcttttgttcttgcctctgatgtgctttctctttgtcttttgtcctcagcctcagactatggcatgaactgccaatcctgcgttccaaccctgaggaccagatcctgtatcaaactgagcggtacatgaggagacctttggctacgaagtgcccatcaaagaggagggggactacgtgctggtctgaaatttgcagaggtctactttgcacagtcccagcaaaaggtgaggcctagtcaggctgtgcttgaccagtaggacattgctgctcttggacaatccacgattatggggctagagagttgagagtctctccagaaaggcagaacagatgagctctagagaagcatgttccatagtgccaaggctgcacttgccttgggggtgagtgacagaaagcaatgccagaatccttgttttgcaactaactgatcctgttaaggccctcctggctacttccctccatggtttgccgcacctcttgtttttagccttatttttcctctgtcccttcctgtgaatttccttcttcctatgctagctttttgtttgtattctttgttccttaaagccaatataagaactcctgggcagtgaagaacacggctttgatttgacccgggttaaggatgctaaccaccctggatatccagaccctcatttcttaaattatttttgaacttcaagcccaaacacgtgcatgatgtccaactgctgaaaggatgtaaagctgatggttttgacattgttttcttttcttatcctggaaggtattgatgtacgattgaatggccacgtcgtggtgaaggacttggatatctttgatcgtgttggcatagcacagctcacgatgaaattatacctatgagcatcagaaaggggaagctgagtgtcagggggaggtgtccaccttcacagggaaactctacattgagtttgtcaaggtaattccctattctgcccattgctgaagagagtgggtacaggggaagttgtttgctgctgtgtgggttgaccactgtttcccttttcctaggggtactatgacaatcccaaggtctgtgcactctcatcatggctgggacagtggatggtaggttgtgttctgacctgcttttttgacttgagtgagggatatggttgaggaagcccttgggaggtaattgagctgatcactattttggaaaccttaaagctaaattgtaggggattcagaatcagttggataaggatgaagcataacatggactagccacaagctttggagtcaggtctatgtatatcttgttgctgccatttaatcagagtttgtcttggatggatgcttttaatttccctataaattgggattaataatggtacctatggtgtaccctgacctttgtagtcatttgggatcacctaaaacttgtccttattctgttgtttgacatctctttcctaggggaaaaaaaggtaaaaggaggagtcctgtaggcttttgtatgctctgaaagattccagcattgctggactgcactgggacaaaacttcacttatttagtctccttatccttgggatcaagtcttagagtatatttctttctcagggtttagattctctggctgccagcatctcaggctgatttttgcagagaaagctgcgtctttgtgacatttccccccattccacctctgtacctttccccaactcaatcttgaatgcactgaggatttcatctgttgtcttgatgtcccccaaatgctgatattatgacatctaggaggatgaatgtcttccaccaaacagacctgtgttcaagtccctgaggaggaggcaggacagagggatagtgtggctgggaacccagaactctctgggtcaacgtttcttcagttgttgtgtgaatcaaaaggaatgtgggcttgtgggaggaggagggatttgaaaaggctaaagtttaggcattggatcatgtccctgtccagtctggttatcttggggctctgtaaaagtagaacaggaaggtaagatgtgaacctccctatgagcacggctttttctactttctagttaaatctaaagcttttgcacactctgctgttctgtagaccagaggctatttctgctacttctggtcttttctctggaccgggttcaatcacagcaatctctttattgtggcttatttgctgcttttaagggtctctctacttaaatgctgtgggtcttaacagtgttttcttccttgtgttagatgtaccaaagctcagcctcatccgggattggagaagaaagaagaggaagaagaagaagaagaatatgatgagggtctaatctcaaaaaacagaccaataagaaccgggtgcagtcaggcccccgcacaccaacccctatgcctcggacaacagcagcctcatgtttcccatcctggtggccttcggagtttcattccaaccctcttctgcctctgccggttgtgagaacaaatgactatcctgaacaggtggaggggtgtgggaaagaaaccagccatattggttttggtttctgtatttttcacaagattaatgaacaaaaacaaagagaaaaaaacacacatcaattaaaggagacaaaaagagcagagcgagtagagagcagccctcattcaccacctggtcccagacgtgcttcagtcctctcctctctttgtggctggctcccagccttctctttcctcttgaggatacttagggtaaatggatccttcctgctcaaggatcctcatttgtatacctagtggaaaggactctgaactcgaggagtcactgttcctttttttaggttagaaattaacagcagggaaatgccatcttatacctgagacgaccagcactgggagttaggtacggtctgaagttatgtctagataagactcagacgtcctgggattgaaagaatgtgtgtgaaggggtagaatttgtgcggtaaagactaaaaaaaaaagtagggagattaaaaaaaaagaaagaaaatgcttccttatctggaagccttctggattaatccagtgatggtcccacctttagtgtttgagctttgtcattgcttgtcccctggcatgtgccagttatagactgtccagcatccaagacgtttcggttatgtcgggtctcagatcgcctctgacttgttaccacaacaaatcattttgatttcagtgcctgttgggacttgatttcttctcagttttgtttgtttgtttgtttccttaatctggctcatttgaaattcttctccctctcaaccatcccactaagttatagccaagaagggaaggagacacggggtttggggttctctgcttgaatgtcttctcctttaccacctcaccttgttggtacctcccccctggatctctgagccagcagccaggaggacctgacccagcagttctttactggccccttgtagggccttgctgccagggggcagggatgctttccagcctgcagcaacagaacactgaccttaaaagtctcttctggtctttggattagaaaaggcttatgttagcatagcttaaagcaacctcagagatttgagccctactaagtgactgaccactgtttagagtgtctggtactgatgttcatttattcccatgttcttgtgtgtcacagttcagccagttttggtttatgctagagctacttcaaggaactagactaattagctatataggcccagcgatgcttcttatgatcttaatagtatgcccctccttcccctgtcctttcatttctctatccaagtagcagtaggttcttggtgtgatgggactgaaagaattccagtcagccagagccttggcagctctgagctaaccttagcatctaagtgtcgatcttgaattccctgaaaaaatttctataggaaagaagcttccctggtcccctcctttctggccattgtcatccatttcccagttagggcaacatgaaggaggacccagccaagctagaaggaattttgtggatgggagacagcaggattagttcagcttgggctggagcagtcaatataggatctcaggccaggcccgcttttctagaattgtttaattttgagtttgctttattagatatgttttttaagagctctgtatatttgaacgctccttatgtgacaaaataggtagctcttgggctcatgtcctgggttttggctctttatgattactccaggccagcatttagtcgtttgagaattgtagcctgttgttttcgctgtgcttgggtctcagtgctagggtattgagtcaggcagctggagggttgtggcccgaggctgagtcagaggtatacttcccatagtgcttcacacagctcccctgcttctaaaggataaggactgtagccttggtcctggggaccacctgcctggggcagtggacatcctaactaaacagcttctggcagtagctttggttcctatcccatcgaaattccccaaagccctgggccactgcattgggttagtcaagatgaaggaggaggactggctgcctccattttgccttgtttgttgtttgcctgggtctgtctgaggaaggagggggtcccgccttccacctcaacacatccctcagtgactcagagtctcagaaggaaaccctgactcctggggccatttcctaatggtacttaagccaagcagctttgcttctgcctctgtttccaagcccacccttttcccctgagctcgggttagggatgggcgctttcctctctggttgtgaacgaaaggaaggaacatctttctaggctaacaaaaactaaaggggaagtgaggaaacaggaagaagtatggtgggggctggggagactcccctggagccaagcctatccagctaacaagagctccctggggctggtcacagcggctcatgatgctgaacttgaaagtttttttgtttttgtttttgttttgtggctcctccagatataggtacatgaagtttaggttaaaggggtgggattctttatttttatttttgtatgtatgtgtcaagaattactctgttgttcaccttttgctttttgcactgtttgttctctatctgtattttgagcttagtgctaggactgagaggctgcaccatagggaatgtatgggaatggtgaggggtgccagtgaggggtgcgtggaggagaggcctgggctcctctactggattacactctgtcccaggtttttagatcccactgagcccagctgactgaaaacaaggacagcagggtgaaacttcttttgccagaagtgtggcctgagttgaatttctgggaggatgacgagatgtctgctgcagagctgggctgagagttctgcagtctagctctgacttaggtcagggcctgttggtctctcattggacgtttttgggtctcactcatgcttactgaaacattgtgcaagaaactctgtgggatttgtgtcccttaaaccagactcacttttctgaaaaatctccttgttgaggagaggctgctcaatcgacaccccgagttctcatgactgggaagatagtttcttcaggtgtcaatggcgttagactcccaggaagactagccctgcccacagggccacctttggtttgagagcgtgttcgtgttctcttgccctccctgcctaagagctactgggatcagttagcgggcatttaggctttgatgagagggcacagtttgagttaggtttacctcccccttctgtgcctgggaactgtttggtccagctttagaactgtggttttgacttccttatctttgggagaagcttctgttttaaggaatttctcttccttcttctcctgcctctagcctctctggaaaggcctggatatggtttctaaaatctcagctgagaacttcagaaaacagcagcgtattttccttttcctagtgctaaaatccctttccctagaaattggctcaccttgggaacccagggaaagaatcagcaggttctctgccctccctaggggttggggaaggacccacccggtcagcacagtgccttttcctctcctgctctgagccagggtggggcattccctctagatcaggtttgggcaggggtcctatagtccctgccatggggctgcttccctgtcccttccccccctttgctggcctactctggcataattcaagtgtcttcttgccttggggatccttagggcatcaaatggcaacatggaatattgtcctccatgcccctccagaaggacctaggagataggtgagctttccaaagtgagagacgaatctttctttctttttttttttaaagggcagatgggtatgctttgggctttctccttctgtggccccggaggaaggagagactgaggcaagcaaagtgatagtacactgaagcagaaccggaaacacccaggaactgttcagaaatctcgaagaaatctgcttctcttcgatggaaagatataattaacgatcaaagagctctaagaaattgcaaagaagccttaatgttcaagctttagaaagatcagagcaatttttctctttcatccaaactaagactctctgtatttaaatctctctggggcaagagggctagatttcctcatttgttatgagactagattggtaccagtagatcagctgcctagcgagggcaggtttctttttgcatctgtgtggcttgcttccagtctggcctgtcctttccagctgccttttgtctacctgctatggggggccagattatcttgataagagcaggtgatttggggactagctgggtggcaggaaaagagcaggatggatctcttgggacaggttcccccaggagtataaacacaagagccaggattgtgctggcagccaaggaaacagtagtgcctgtttgagttggcagagaggccttggcacctcttgcatccaggcagtcttgtgagatgggggcacatagcactggggaagcagaactccattctcacctctattttgagcttcagtgctttatttcagtatgaggaaaacaacaacaaactgaagtgcgctttccgtcctttcaaaggacaactgtcgggaagggaagccgagttgcgaggtaggaggggagcactggcagggagagacattcttgactcctctctccctggtgtgttgtgatccagggaatgaaaagaaatttgaccctggattggttctctcttggacttaaggaatcttaccttttccttccacaaagttctcccaggcaaggaccagctcccattctgagcccagggcagcctcttcaaccattattggtctaacctggcttgtcaggaaccaagcccacccttccacattgggcctggctgctctattctgtaccaagtactggagaaaagcatcaagttcttagcccttgtagcttctaccctagtttcccatcctctctctgtgaggccaaaccaactctttgccagcagccacaacatgcattgacagcggcacagtgagaataactgatgggctttgaacctggttggccggggaagctgtaggggtggatagagctggtttccttctgggctgtctccatctgaccctaccccttccatgtcccaccccactcccacaaaaagtacaaaatcaggatgtttttcactgtccattgctttgtgttttaataaacaattgcagtgacactctgtgttgggactgagttcgaacttgatctcaaagcgctgaagtgatgggtgggaaaaaggagacccaggggttcacttggctccaaagagttctcctgtgacgagctgggaactgttgtccatttagctgtgtgtcttttgcttttcttctctctgggatgtttcttaggggaatcattctgtaaaacccttcctggtcatttcaactagcagcgcatttaagacaaaaaatttgttttcactttcactggaacaactaggcacagactgtcccactcttaagcacactgggcctattgctgcctctcctcaccattcccttagcctctgtgatagcccacgacaagctaagctaacctaagccataggagatttttctctgcttgctccttttctggtgtttgtcattgttgattacacattaggaagagcagaatgcaggagggattttttttcctaaatttataagccacgttttacaggtgaggatcgttgagccaggcatggtggcttaacgctgttatcctagcactttgggaggctgaggccagcagattgcttgagcccaggagttcaaaccagcctgggcaacatggcgaaaccctgtctctactaaaaatacaaaaattagccaggatggtggtgcatgcctgtagtcgcagctacttaggaggctgaggtgggaggattacttggcccaggaggtcagtgctgcagtgagctgagatttcgccattgcactccagcctgggtgcccagacacagacacacacacacagacacacacatacacacacacacacaaacactgaactcaaaaaagttcagtaacataccccagactaatgtagtaaatggtctggtcaagccaggttcaaattcagtctgtttgccatcaaagccccaagctctttaaagctgtaaagataatacagctgtccattactgagtccttgaaatgggctgggcacaatgcccagcattttccactgttatctctcttttatcttcaacaaaccagttgctattcccctttaagagatgaagtgcttgcacaaggtagcacaaccaacaaaaggcggagctggggttttaaaccaggactcctctctccatcattaccctctgctgccatccatttcttcatggtgctgggtggcatggctcagagcctacctgcgggatttctccgagtgggaatggagactgctggcttgcaggggtaggaggggtggaggtggaggaacaggagtttggcctacctccctcagttatcccttgaaggcagaattcagtgtgcagccccaagagtgaggccattgttgatggagtctgttctcagggccaaacaagccaggaggcccacagagcctctttcttaggctgagcccacccataactgggttctttcctaattcagatttcgttgttactatttcaagtagctttgcatgagctgccaatggggaagagacctgaagaactcctgctctagggagttacagggagggaaattgtctgcagaagatcttgggccaagtaccggggttgggttggaccactctgtgggtccagatcttatcttactaaggaaatcaggctcccggttggctggagccggtgagacctttctccatactagtaccccccatcccccataaaggaagagagatgagtttttctagtacttactggaaactcattgctatcgcagtggtgaggggtcaaggcagaaaggaggcggagcatggaggtccggagcgggcttgcctctgctctccaacaacctaaggccacaagcacctcgctgcagcacctggcccaagagtctcagttttgtttgttcctaaccacttaacattagtacgaaataacccacttgctttgtcactgcactctctcacctggatccatggcttctccctgccccatgccctgccctgtgtgcctgccctcaacagagggggcgtggagaaagaggccacttgtgtatttgtcatagtgaccattcatgggacactcttcctggcaccagtacagtgctttttcttgcgttttgtgtctcttcataacaatcctaggaaagacctgtgactagcctgacttataaagaaggcacaaaggcctcaggagagaaacgacctggccagagtcacatagctggtaattgcagagcaaagactggaacccaatgctgtttgaccccaaaatctgtgcttttagtgccatatatactagttttaaagaggaacctttgagtattgataactgatgaatctatgattacaggaggttttattatttctctgaaaaagtaacttttaagacttggtgatacaaagatctaaaatatatacagaaataaattcttaaaaaagtgttaggagtgcaaaatgtgaaaaatcatttcttttctttttctttttttttttcctctttttgaggccgggttttgctctgtcaccaggctggtgtgcagtggcaagatcttggctcactgcagccttgacctcccaggctcaaggatcctcccacctcagcctcctgagtagctgggactactacagtgtgcagccaccacaccagctaatttttatactttttgtaaagacaggattttgccatgttgcccaggctggtctaaactcttggactcaagtgatccgcccacctcggcctcccaaagtgctgggatcagagggtgagccaccatacctggcctgaaaaatcattttcttccctatccctctaatccctaaagataatacagaggacattctggtgtgtatctttcattttaaatgtatttacatatatattgtgtatatatgtatttatatatatgtaatatatatgtaaatgtatttacatatatgtggtaaatgtatttacatatatatgtatttacatatatatatatatacacacacacacacaacagagtctttttaaacaagtgggaatataccatacatatcattctgtgccatttttactaatatgtcttagagaggtagttcatatagatgggtcagtacatagagattttcctcaccaagggctgtacagtatcttatggttagattgtaattgattttaccaatcccctgtagagaacattaagatactgctcattttttgccagtacaaactgctgcagtgaacatgcttatcatatatctttgtgcgtatgtgcaggtgtttctttagggaattcctttaaggaattactgatcaaacaatatatgcatttaaaaatttgaaagtactgtcctccatgaggctatatgatttttactcaccaatcttgtgctgtgactttggaatatgccagaaatctcttttggaaaaggtaggatataaataataaataatgctttttaaaaacagccctctggctaagcgcagtgctcacacctgtaatcccagcactttggaaggctgaggcaagtggatcacctgaggtcagagttcgagatcagcctggccaacaaagtgaaacctcgtctctactaagaatataaaatagccaggcgtggtggtgggcacctgtaatcccagctacttgggaggctgaggctggagatcacttgaacatgggaggcagaggttgcagtgagccaagatcatgccgttgcactccacctggcaacagagcaagactccttcttaaaaacaaacaaacaaacaaacaaacaaacagcctcagccagatagtagagtgacttggtactaaggaaattactagctcttagtcccagacacaagccatgcctgcaatcccagccatgatttgctaattcagtgcatgccatctggggagcagcagaaagcaggactgaactttcagtcttggcagaaaaatgccagctgatgatgtctgcttaccttggttacaccagctctgggccccacctgcctggcctgatttgaaggcagatgcctggctactctgggactgccctggaaaacagccactctcacacctcttacagggagaaaacagccagcgggagagagtcagccctgagctggggggaaaggaaggctggccctctcttttggtgtcaggattactatttaatgcagtagtcctctattttccttcttcccccaataaagtgttagtatatgtaattttcaaaagacattttaaaagagcctttccccacacctaaaaaatttgatgtggaaaggcagattggcggttacacccctaatttttcctaccccttaaaaaatgaaattatatatatttccttccctttccctttccttcatttccttctttctttctcgtttccttcctttccccccgtcctttcttacagtctcactctcacccctcgaactctggcctcaagcaatcctctggctttggcctcccaaagtgttggtattacacgcatgagcactgtgcccagccagtctattccttttaaccaaaattcataggtagtgcccagagagatacaagctctgactcatatggcagtatttacttaaaaaaaaaaaaaaatgccaggcatgtggctcacgcctgtaatcccagcactttgggaggctgaggcaggcggatcgcctgaggtagttcaaggccagcctgaccaacatggtgaaaccccatctctactaaaaatacaaaaatagctaggtatggtggtgggcacctgtaatcccagctacttgggaggctgaggcaggagatcgcttgaacctgggaggcggaggttgcagtgagccaagattgtgccactgtactccagctgggcgacagaatgagactctgtctcaaaaaaaagaataataaaaataaaaaataaagaaaataaaaaaacaggccaggcacagtggctcacgcatgtaatcccaacactttgggagctgaggcaggtggatcacaagttcagaagatcgagaccagcctgtccaacgtggtgaaacccgtctctactaaaaatacaaaaattagctgggcatggtggcgcgtgcctgtgttctcgctacttgggaggcggaggcaggagaatcgcttgaacccaggaggcagaggttgcagtggccgagattgtgccactgcactccagcctgggtgacagagcgagacccgtcagaaaaaaaaaaaaaaaattaagtttgaggttgcttttaaattttaaaagatttgtaaggcaactttgcatagagtttgccttccagacacagatccaaaagtattttcttttctttttttttttttgagacagagtcttgctctgttgccaggctggagtgcagtggcgcgatctcagctcactcaacctccacctcccaggttcaagcgattctcctgcctcagcctcccaagtagctgggataaaggagtgtgccaccatgcccggctaatttttgtagttttagtagagacggggtttcccatattggtcaggctggtctcgaactcctgacgttgtgatctgcctgcctcggcttccaaagtgctggaattatagccgtgagccactgcacctggccggtattttctttttaaaaagtatacaagcagcccatgattatatgcttgagataaaatagtacagaagtagtagttctaataatgtcaaaagtgaatatatttcctttagtctcttctgatactctcctccccagactaatcaaagttaatgttttaatgtatatccagacctcttcctttacagttacaaatgcaatttatatttatgtctatgtctatctgtgttttttttttttttttttttgagacagggttcacgcccatggcccaggctaaagtgcagtggtgcgatctcagctcacacagcctcggctcctgggctccggtgattctcccacctcagcctcctgagtagctgggactactggcatgaccaccac

SEQ ID NO: 5020 - DNA, 34116 bp, Homo sapiens
  misc_feature (2379)..(2398): n is a, c, g, or t
  misc_feature (18551)..(19706): n is a, c, g, or t
  misc_feature (29945)..(30307): n is a, c, g, or t
acgctgtgggggtgcatggctgggttcctcctagggcagcagggctctgagcagcgggcttaaatgagccatttaacagatggtacaggagggtaatgcacgggctcagggccccacacgggagctgctggagtcctacgccaccccccgcctggaagggaagatgtctgctccacaagccctggggtcccctgtgggcagggtgtgtggagctgccctcccctggtctccccaggcagacccccaccctccaccccaggtgccttagggtaggcgtggcctccccaggtcctgcagccagagccaggctgaccccagcggccctgcaggtcacctcctaggggctgtgcccggaactgggatggaagcgacaggctgggggcagagtgtgagcccagcccagggcttgcgatttgaaaccagtgcttccctcccctgctcacctggccagtaaccaccgggctggggtgtctggctgggctcaggccgggctgggggcctctcctgatgctgctggagggcagactgggcaggtgcccccaacagtgtgcgctcggcctggtggggctgagaaacctggaacatacacactgtgggggtgtctaaggggctcccagggagttctggggggtcctggggagcaggaccccttcactccctcctccaggggaagtggccctggggcacccccggctgttcccccagctcgtggggccgaagccatccacagggggctttccccaccggatgtggtgcgggccgtggttatctcacttgagttagtcacccaggacaaacagctaaccgacacaattcctcccaagtcagggggccggaggcggggtcagcacctggcggcaggagacagtgctgccctgggatgtgccgggcctccctccattcccaatcctgttgtctctgtggcaatacctggctgggagctctatcaggcccgtgacccccgccctttctccagtgccctcctgtctgcattcacctgtcaatcccgaggagagaggggcactggcggccgcccaggaccagagctgtggggcctcccgcccagagtgcagtgaaggtttgtgggctgcggtcccggcggagcccacgtgccacccccagcacagctttcctcctgcacatcccacagaagcaaaagctcccacctgcccggcactgtcccgccctggggaccctcctgcaaacactttccagatgacaggcagctgctggtcccagcacacaccttccctgaaggtgcctctcacctgagggtgcaggttcaagtcaggagggtgactcctgcccggtggggtcatcacccttctcaggggctgaggcagggtctgctttagggttgcgcctgcttttcagacaccggcccccaggcccctgctgcagccccacccggaccgctgcgcagccgtgcccgctaagtggtcggcgctgcgggcagggtggccggggcatcagggtccgagatgcaagtgctgggcttggctaccacggggggtcgggagctcacgggggaagatgatcctgattttgaggccaagtcgctggtcttacacctgtcctggctgccggtctcaggctgacaccggccccaggctgggggaaggtatccagccggcctggccagggcccctgctggaggcagcaggaggagttattgtgctggatgggggttgggagctgaggggactggagaggcatggagccctccggtgggtgggactcccgggcatatgctgagagctttaggcctcaggagggttcccaggaggcaggtggctgcgccacggctcggccagccctgcctgcacccttgagagcccccagcaaggctgcagtgaccacctcagattcccctctgaggcctgtggcgggccgggacctcactgcccctggggacacacagaaaatgcccacagagctcagaaacaagcccagtgggttttctggaaagttctgggtgtgtggagcctggggctgtaggctctggactgtaggcactggcttcaggcctcctgaggcctcggcctggtggggttttcatgggaccggtggtcagcccgtggcccatgcccaggggttttgggtgcctgagcccaggccccaagagaagcccagcacagccaggggtcaccaacactggtggggggaagtcaccccagctggacccagcagcggccctgggtgacgtctggctgagggaggagaaagctgtggctggggcggcaggcctgggtggccagttggccaggtgccccggggcttggcccagcctcagacacgcaggggcactcccctctgagggccacgctggtgactcagactgttcagaggtcacggtatggctgggccagtgactcaggnnnnnnnnnnnnnnnnnnnnctcaggcctgtcctctgttggggctggacactgactcacccactgcctcctgtctatctgagggcgtaaggagggcaggcttcaggcactcacatgcggccctggccagggtcccggtcacacctgcagaccctcaagccttccctatgccccactgacataaccacctggccctgggatctggtcccaccgcggggccattgtccactaccaggaccctcctctgccttcatcagcaccaggcgacctggtgtccatcctgggccagggcaggggaaccctggctacacctggtcgagtcagacctcctgaagcacagtggctggggtggtccaccctaaccctgtcagccgctcagccttaaatgtgatcactgctcagtcagtcgccacccactcactcactcacccactcacttattcactcactcacccctcacttattcacccattcactcattcattcacccattcactcactcacttattcactcctctctcactcattcattaattcgcccattcactcacactttcactcactcacttattcctcatacactcattcacttatttactcactcattcactcactcattaattcacccattcctcactcacttattcactcatagactcatacactcactcattcactcacgcatccactcttcactcactcatttacccactcattcactcattcactcactcactcatttattcacccttcactcactcattcattcactcactcactgactcattgactcattccctcactcattccccattcacttactcattcactcacccatttattcactcactcactcatttactcattcttcacccattcactcactcactgactcattgactcattcactcattcacccattcacttctcactcactcatttactcactcattcattcattgactcattaactcattcactctctcttcactcactcactgactcattaactcattcactctctcatgcatccactcattcactcctcactgactcactcattcactcactcattgactcactcatttggttattcactcattcctcactcactgactcattcactcactcattcactgctcacttattcactctttcactattctttcattcacattcattcattaactcagtcactcactcattcactctcactcattcattactcatttactcattcactcatctattcattcactcattcactcactcattcattcaccattcactcattcattcacccattcactcactcacttattcactcatagactcatacatcactcactcattgactcactcactcattcactcatgcatccactcattcactcactcattactcactcactcactcatccactcactcactcattcattcacccattcactcaatcatcattcactcactcactgactcattgactcattccctcactcattcacccattcacttatcattcactcacccatttattcactcactcactcatttactcattcattcacccattcatcactcattcactcactcactaactcattgactcattcactcactcattcccccttcactactcactaacttatttactcactcattcactcactcattcattgactcattaactcatcactctttcactcactcactgactcattcactcattcactcactcattcactcactcaccactcattgactcactcattcacttattcactcattcactcactcactgactcattcaccattcactgcttgcttattcactctttcactatctctctcattcacatttattcattaatcagtcactcactcattcactctctcattcacttactcatttactcactcatttactcatcactctctcattcacttactcatttactcactcatttactcactcactcacctgttcatcactcgctcactcattcacattcattttaactcactcatttactcatagactcactcattatccacttacttattcattacctcattcattcactcactcaatcattttccctttcccacactcctgccacatgtgaagtgctctttctctaggcacctgggctaagacaggacatgggagggaaaggcacagaaatggagaagtaggcaatcataaagagcttgggacgggtcctagagagctggaagcaagtgctcagaacagccttgaggcacctcttcgaccctaaccccctgcagcaggacaaagggcccagcccagcctctccctttcctgccattcctcccatggggaccttctggttggacgctccacatgggcagtggagcagccgaccttggctggggagtggtggctgcctgggagggagagtctagccacagtgtccagccacacacctgtggtctgggaagtgttcatcacacaacagcaccttctcagccagagcccttcaggccaaagactcactggacctttctgtgctgggactgctcggaccagtcaacagcttcctgtccagagggtactagcatttctggatcttggtggccagagaccatcaagtgacttgaactggccctgcccgctggggtcaggagacagaagcacaggtggactcctgggcaatgctgggagggggctgcatgtgagggaggggttctatcatttgcctggaggctgctgccaggagcccctctccagggaggtgaggctggctggcgctacttcagtggcagcatgtggctggcctgagggacgccttgctcactcactcctcaatcactcatttactcattcattcactcactcaatcatttttccttcgccacactcctgccgcatgtgctctctctctaggcatccgggtaagacaagacatgggagtaaaaggcacagaaatggagaaataggtgaccataaggagctttggatggggctgggctggcctctccctcccaggcagccacacattccccagccaaggtcggcagctccactgccatgtggagggtccaaccaggaggtcggccatgggaggaatggcaggaaagggaaaggtgggctgggccccctgtcctgctgcagagggattagtgtcaaagaggtgccttaaggctttctgagcactcacttctgggcaccaggaactcacaggctgctgggcatggcacggtgccagggagagtctagggtggggtatgtggggaggacccctgcaggccagggcttggggggccctcggaaactgggctctacccggcagacacacccatctccgcctgccaccggccgctgccagcccgcagtgagcacccactgtttacttgggtgagggggaaccacaggccccgcctgcccacccacgtgaagcacggggctggagccagctctggggctacaaaaagctcctgcaccttgggtccctcctcagaggctgctgagggacagggcactcttccccgccgtccacaaatgagtgttggccggaggaagctggccctgctctgggccctggctctcgctctggcctcacccggcacacaggtacggcttggcccctggccgctctactggtcctgggtggtgcggactgagtgggcctcaggcagctcagtctttgccctgggttccgggcaggctgcatgtgcatgaacggctcccagcagcatagcccctgactgtggcctggccacgaacgagcagtttcccttgtggggttgggaagggatctctgggcttcgcggacctctgaggctgggccattcctgaggcagggaagtaggagctcagatctcgggctttccctcccggcccggatccctgcactgtccccagaagccgacagcacctggcccacagtatctccagctgctcatggcccctgtgggcctggtcggggcatcagccccaggcacctgcccttgcacaccccacacatgcccattcaccagctcacgttccctgtctgggcctcgatggggatctcctgcggggggaggtctagcctctgagctgggatgtgatggtgaggcccacaagggaactgtttcaccgcccccctaggctaagagggtgatgggggaggctccaggtcctgtggtctggactgccccttgctggccagcaggtcccttcctctgcttctgagggacacctgggaccgggtctgctggtgaccagtgcccccatggggtaatgccggggtttggaggggggtgggtgctcctgggctcctggacagcagggcagggacctcagcactgccgagaccgccacatggcccacccaggtccctcgccagccctgtccccagcctctggccctctgccaggcagtctcagagcaagaagaacccttcccggtgtctccgtgccaccctccactgtggcctagtcggactctgccccgccgtccccgtctgtaccaccctcatctcagaagcaggaattctgtcccggggctgctcccaggagaggcggcgctggggctggggtctgcgggggctcagaaggtgggggcaggcctgggctgggctagataagtgaggctcaggccgtcatctccgtctcccccacggggcttgcagatgctacacccctccgcccactgacggatttgatgcagtgggccccactggggccagagggtgtggggcgaggggggtctcccagcctggcctgaggacccctatgccagttgcgggaactggaagctggggctggggtgcaggcgaatcacagctttccctaagacccctctctgcaggtccgggctgggccgggcgcccctcccaccatgctggtgctgtgcggggctgtgcggggctgtcggggctggggtccagtcccacgatgatggtgctgggcggggctgtgcggggttgtgtgggggtctggtccccccatgctggggtgctgtgcggggctgtacgaggctgtgaggggcttgcgaggctggggtctggtcccaccatgctggttctgtgcggggctgtgtggggctgtgggggctgtgtggggctgtgcggggctgtgcggggctggggtctggtcccaccatgctggtctgtgcagggctgtgcggggctggcgtctggccccaccatgctggttctgtgcggggcgtgtggggctgtgtggggctgtgcggggctggggtctggtcccaccatgctggctctgtcagggctgtgcggggctggggtctggtcccaccatgctggctctgtgcagggctgtgcgggctggcgtctggccccaccatgctggttctgtgcggggctgtgtggggctgtgtggggtgtgtggggctgtgtggggctggggctggtcccaccatgctggctctgcgacgggctgtcggggctgtgtggggctggggctggtcccaccatgctggctctgtgcagggctgtgcgggctggggtctggtcccaccatgctggctctgtgcagggctgtgcgaggctgtggtctggcccactatgctggctctgtgcagggctgtgcggggctgggccgggctgaaatctggtgaattctgcacattagcacagtctctatggaccctgaagatcagcctcctgcagggtctgcgcttgtagggaggcagggtcctccaggtggtcttggggccgacccctcccatgcctttgctgctccagcccctcagtgggatcactgtactggacaggggtcccaagcgtggcagcgtggggccagggcctggcacgcttggcagtgagtgggaatgaatagatagggatgccagatggggcgaagggtcctgacgccacctgctccatggggccaggctgaggagatgctcctgggggtctgggctcagacttcagactcacatggacagaggcctcctaggaccccccaacccgcacagagagagcccttgccacgggccacccccacgcactgtggcctcccgtccctctgtgtccatgctgcatctgtggccgcagcctgagccccctcagccaccctgcatctgggctagcccccctcctctttctgcaggccatgcccaggatggctcctccgaatccagctacaacaccaccctgccctctctcctatcgcccgggggcccagcggtgagtctgagtgtccggccccaccctaagcctgtcagattccaccctccaccgtgtggcacggcccctagggccactgtcttagggtggctccccagctggccactgctgaggaccaaacctggggggacaggaggcacccccacatccatggccctggtcggtcacactacctgcctctccttgggccagcccctgcagcgcttaggctctgaaggagctgcagggcggggcagatttgctgtgcccatgtccgtgggagccggtcaccctccggggatctggagctgggtcctgccttggtgtcccccccgtcacctcctgacgcttcagcaacacgggcatctcccttggcgccggccgtccccatgtgctcgtgctagcgggagcccgtggaggcccagcagccctggcagaggcagggcaggcaaggcagccagggcagggggcttcaggcaaactctcagattgcatttctccaaatcgggccaacaggcctaatctcagcacctaagagattgtcttgagccgctgatgcagactcaggttcgaggcccatgggcatgtgagagctggcagcccctggggacttcttcctggtgacagccggaggaatgaaaaagtcaccgaacgcagggtgtgtggtcacaagtacacaacgtgcagatgtgggtgggtgggagggggcccaaacacgcagcagaatccggagttggcttcggagccagagctgggacctgctgactctggaacgtctcctctggctgcggagcccccgccccacgtgggccgtgcgtgaatcctaccagcccctgtctccgcaggggtcccgctccgtggggcgatgtcttcccatctctgaggaccatccctgtggtacgaggtgagtggagcccggaggcctggtggggaagggtcatagctttgctgagctccccgctcaggcctggaggtgccgggtgggagaggccccagctttccgggtgaacactgggtgggtattggagccagagggcccagcactccctgcacacgtttctgggacttcccagatgcaggaaggacccctgggtgccccgtcagggcagcagcacctcctgcaggaccctggggaggggcaggaggtacagggcagaggcaggggtgcagggcgaggatgagggcgacgcccccaaacaccatgctgcttccaccgcagctccaacccggcgcacaacgggcgggtgtgcagcacctggggcagcttccactacaagacttcgacggcgacgtcttccgcttccccggcctctgcaactacgtgttctccgagcactgggtgccgcctacgaggattttaacatccagctacgccgcagccaggagtcagcggccccacgctgagcagggtcctcatgaaggtggatggcgtggtcatccagctgaccaagggctcgtcctggtcaacggccacccgtgagtctgggttctgggatggtgggggccacgcggcgttggggtggcatttccgggtggttgcggggtttcgcggtcctgggagggatgtggatttccaggaagcccctgagagcagagctggacatgggccctccctcgtcccccgagtggcccactgcccctcctgggatccccaggctcttattctgccccttcctagctcctcgtgaccccgagctccagaggtcaatgtccccatcccagacgcgacttcacggtcacgatgaccgtgtacatttgcgaccgcaggcatctgccctgcctggggtctctcctcactgcgctcccagccctcagccctgccttcctccacagggtcctgctgcccttcagccagtctggggtcctcatcagcagagcagcagctacaccaaggtggaggccaggctgggccttgtcctcatgtggaacacgatgacagcctgctggtgaggctgggtgggggtgtcccggtgtgcaactccagccccgagggccggcctgctcccacagcctctccggagagggtagaaggtgccctgggcccagcagggtcagactccaccccacacagcaggcaagaacaggtgcccagacaccaatggtgtccggggtctgtgcccccaggatggagactgctttcgggggtgtctcttccgtgggcctcgcccctcctcggaaatctcaggctcgagcctcatctgtccatctgcccctggtggggatggtgtctgatgtctctccctttgcagctggagctggacaccaaatacgccaacaagaccgtgggctctgtggggacttcaacgggatgcccgtggtcagcgagctcctctcccacagtaggccccacatcgccctcagccccttcctcagtgtcccctgggggctcagtgttgtgtgacacacaccctctgacactccgggcacacacatgcacagatacacggatgcagctgcccccctcctagcacagcacacacgtgcacacacgcgatcccgcaacgccggcctgtctcagagtgcaggcagggagcaaatcgcccattgggccccttgctctgtgtggctgctctgggtgcgacccctgactgcacgccctctcctgaaatgacagacctgcctccttcttggtctttagtctctgccaccaggcagtggccttgcaaatgtgacctgcaccagccaaggccccactcctgcctcctcctgccaggcccatgaagccccatacaagccccgagtacagggtgtcccctgtggggaactgagtctgcctgggtgtccagcagcccttggcaaggcaggctcagtgcgggttggctgggttctgtggactgggaggtgttcaggctccagccagcctggcaggagggaccagggtcctgggtcagttgaggcctcagccggcggcaccctgtggcccggacaccacctcctgggctgtttctccccatcattccagaccccctgagggtcccagcagcatgcatgggtggccaagcgggtgcagtcaggacaactcaggcatccagatggggcaggagccaccatggcccttctaaccccaccccagggacccggccctgggggctctgctgctcgggtgctggctgacgggtaccgggacctgcaggcagaccccgcctctgtgcttgccgcagacaccagctgacacccatggaattcgggaacctgcagaagatggacgaccccacggagcagtgtcggaccctgtccctgaacccccgaggaactgctccactggctttgtaagccttggagggacagagggcccagcaggttgagcaggaggggttgtgagcctgggaaccggtccagatccccaccgaggactcagacgggctgtggcctttgtcctagggcatctgtgaggagctcctgccggccagctgttctctggctgcgtggccctggtggacgtcggcagctacctggaggcttcaggcaagacctctgcttctgtgaagacaccgacctgctcagctgcgtctgccacaccctgccgagtactcccggcagtgcacccatgcaggggggttgccccaggactggcggggcctgacttctgccgtgagtgtcccagccccctgtcccccaacccctttggcagggagggcagggcaggcagacgtgagccctctctctgcctcccgcagcccagaagtgccccaacaacagcagtaccacgagtgccgctccccctgcgcagacacctgctccaaccaggagcactcccggcctgtgaggaccactgtgtggccggctgcttctgccctgagggtgaggctcccccgccctgggaaacacaggtgcaccccgacaactagggggctgtgctcccatggccaagcctcgaagaaggaccccagtcctagtgtcccgggcccctgaggctgactgaggcccctgtcctggccgctgaggctggctgaggatcctgtcctgggccccctgaggctggctgaggccccttcctgggcccctgaggctggttgaggatcctgtcctgagccccctgaggctggctgatgccctgtcccgggcccctgaggctggctgaggcccctgtcctgggcccctgaggctggctaggatcctgtcctgggccccctgaggctggctgatgcccctgtcccgggcccctgaggcggctgaggatcctgtcctgagccccctgaggctggctgatgcccctgtcccgggcccctaggctggctgaggcccctgtcctgggccccctgaggctggctgaggcccctgtcccgggccctgaggctggctgaggatcctgtcctgggccccctgaggctggctgaggcccctgtctgggcccctgaggctggctgaggcccctgtcctggccccctgaggctggctgaggccccgtcccgggcccctgaggctggctgatgcccctgtcccgggcccctgaggctggctgaggccccgtcccgggcccctggagctggctgaggccccagctcgctgtggggccgccatgttttcccctgcaacgcccactgcgtggacacagcaggcgcccgtcataggcctgcctgaccctgcagggacggtgcttgacgacatcggccagaccggctgtgtccctgtgtcaaagtgtcctgcgtctacaacggggctgcctatgccccaggggccacctactccacagactgcaccactggtaggtcccagcccccctccaggcccccaggatgtgctatgggacagacctgctggggttgcgacccaggccggcaggcaccctcgtctgggctacggtgtaggcaggcctgggtgagacccggtcagcctcctgacgcggaggctggaggctggtctcctggggccggcaccacgtggcaccatctcttgctctcagcacctgctccggaggccggtggagctgccaggagttccatgcccgggtacctgctctgtgcttggaggtgcccacttctcaacgtttgacgggagcaatacacggtgcacggcgactgcagctatgtgctgaccaaggtacggcctggctgctggggtgctcgccggacagagggggcccatggccagcctcccacaggctcccccagcttgctgcatgtcactgctgcccctggggtcacccttgggggtccccgatgttgagacctcaggaagcactccagctccccagcgctagtcctcacagggccatgaaggctgcagatcagacctccagcacccacccagcattgggcctcacccagcactgggccctctgcaccttgggcgtttatttaacagactttactcttgagaatagttttaggttaacaaggaaattgagcacaagtactcctgccccaacacacagtgtccccacgatgagaccctgcaccaaacacacagctctcccagaggagaccctgcacccaacacacagtctccctatggtgagaccctgcaccaacacacagtctccccaagatgagaccctgcacccaacacacagtctccctatggtgagccctgcacccaacatacagtctctgcacgatgagaccctgcacccaacacacagtctccacgatgagaccctgcaccaaacacacagtctccctatggtgagaccctgcacccgacaccagtctctccacaatgagaccctgcacccgacacacagtctctgcacgatgagagcctgacccaacacacagtctcccacgatgagaccctacacccaacacacagtctctccacgatagaccctgcacccaacacacagtctctccacgatgagaccctgcacccaacacacagtcccccaagatgagaccctgcacccgacacacagtctctgcacgatgagaccctgcacccacacacagtctccccaagatgagaccctgcacccaacacacagtctccccaagatgagacctgcacccgacacacagtctctgcacgatgagaccctgcacccaacacacagtctccccagatgagaccctgcacccaacacacagtctccccaagatgagaccctgcacccaacacaagtctcccacgatgagaccctgcacccaacacacagtttctccacgatgagaccctgcaccaacacacagtctccccaagatgagaccctgcacccgacacacagtctccccaagatggaccctgcacccaacacacagtctcccacgatgagaccctgcacccaacacacagtctcctatggtgagaccctgcacccaacacacagtctctgcacgatgagaccctgcacccaaccacagtctccccaagatgagaccctgcacccaacacacagtctctcccagatgagactcgcacccaacacagtctccccaagatgagaccttgcactcaacacatagtctcccccgatagaccctgcacccaacacacagtctcccacaatgagaccctgcacccaatacacagtttcctatgatgataccctgcgctggggtggaggctgcactggtaccctcacctcccaggtctggttgacatcagcgaccctcgtggtggtgaaattccacgtttaagacagatgtgcagttcttgttcctgccaggaagtttcacgcagacagctccactgccctgaaaccccttggagtcctcacccctctctcgcccagcccctggcagctgctggcatttgcaccttctgagtgcgtctttcccagagggtcctatagttggcgttgcagagtgtggcctcctcagggtgcatgagatttctgtgtgtgcctgggtgtccacacctgggggcctcctagcacacctccctctcgggactgggatggtggagtggggttttctagtgagggagaggagcacagccgggtggacggcagggccaggtgggctgggcgttggatggagtgtgaggacccctggtgtgtcgtgttcgcagccctgtgacagcagtgccttcactgtactggctgagctgcgcaggtgcgggctgcggacagcgagacctgcctgaagagcgtgacactgagcctggatggggtgcagacggtggtggagcctggcagggcaaaccccgggaagagggaaggggcctgtctcttctgcaagtccctctgcccaagcccttcatccctggcatgaacagcgagaggcggggaccctctggcaaactggctgtgtccattacttatgggtccacgtgactgtccctaaagggagaagctcaggccgggcctcccgggccgccatacctgacccaaggggccccaggaaggagggactgggcgacctgcggccagcatggcttctccactgaagtcaatttatgtttagttaataaccttggtttcactgaagaatgaaaggcatggtcctcgcagaaaattcagaaaatcaggcgagcacaggccaccttgtaggagccgcagctggagggaaaggcctcccaggcacctgcaggcacattcacagcctccgcggggctgaggtgccgcaagcctgccccgcgctcacacatctgtctgctgccctcaggtggtggtgatcaaggccagtggggaagtgttcctgaaccagatctaccccagctgcccatctctgcaggtgagggcagtggcttcttccccaccccggggctgcctgggtcccgccccacagcccccagcaaaacccttgtcctttgtgtccccagccaacgtcacatcttcagaccctcaaccttcttcatcatcgcccagaccagcctgggcctgcagctgacctgcagctggtgcccaccatgcagctgttcatgcagctggcgcccaagctccgtgggcgacctgcggtaagagggctgccttctgggcttggagcccacccactctggccagggcgctggtcctcaacctgcctaacccgcccccaggtctctgtgggaacttcaacagcatccagccgatgacttccggaccctcagtggggtggtggaggccaccgctgcggccttcttcaacccttcaagacccaggccgcctgccccaacatcaggaacagcttcgaggacccctgctcttgagcgtggagaatggtacgggtgtccacggctcgcctctgtgctggccgcctggcgctgttcacccgcttccatttggcactgcaggcagcgaggctggccctgcgtgtgcctgtgaccgggtggggtggctcacgaaggggcccaaggacaggctcatggtgggcgcccaccccacttatgtggagcttcaggaatgtggggcatctgcttcagggtcaaagaaagggtacaagctctgttggtcaacatccgccctgaccgcctacccctgcacagggtggagtggtggggagtggggaatggattcacccactcacccacccgttcacccattcactcactcacccactccccactcacccactcactcactcacccattcacccactcacccacgtcactcacccattacccactcacccactcactcacccactcatccattcactaactcacccattcacccactacccactcaacactcactcacccactcacccattcacccactcacccactcatccattcctcactcacccactcacccactcaacactcactcacccactcacccattcactcactcaccattcacccactcacccactcgctcacccattcacccactcacctactcactcactcactactcactcactcactcatccactcattcactcactcactcactcactcactcactcatcactcactcagtcattcacttcgccttcagagcttgggcgccagccgtggggaggtggatcccatttgctggttctggccttcttcctgcagcctgggaagccagggtccagtgagccagtggaggggccagaagggccttggtttgtctgtccacagtggtggtcactagcgtcctggaaggcggcactgtgagaggctgtgaggggctgggtgggacatgcaggaaacgagagagcctcggttctggatgttgtaccctgcgtttgggggagcttttcctaggggagggcgcacaccacccgggctgagtgtgtagcaggatgaagggcccaatatcagactgcccagagagctggcaccccaaaccccacaccagaggccaagctgggtgggatgagtgtgctgcctgacttaatcctaaccctatccctcctctgtccacagagaagtatgctcagcactggtgctccagctgaccgatgccgacggccccttcggccggtgccatgctgccgtgaagccgggcactactactcggtaacatctgccgcctcttggcccggtggggctccagccactgagcctcaggctgcctccaggagggctgggagggcactggtgggctcagcaggcaggactaaccttttaggctgtgatgggcaccaggggctggaacccagtctgtctgtccagctccattccccaatccccacccacccattcactcattcacacattcaccactcacccacacactcacccatcacctactcactcacccgttcacccattcactcacccactcactcacccattcacccattacccactcacccattcactcactcacccactcatccacccattcacccactcactcaccattcacccatttgcccccccactcactcacctattcacccatttacccactcacccatctctcactcgcccactcacccattcactcactcatccactcacccacccattcacccaccactcacccgttcacccattcgcccccccactcacccattcactcactcattcactaactactcactcactcactcacccactagctctttcactcactcactcactcattcattcaccatatcttcactgactcattcactcatttacccactcactaattccttcacctactcatctacttactcattcactcatccgctcactcatttactcactcattcacgaatttgcttcctcatttactcatttactcactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattactcatccactcactcatccactcagctgattccctcattcattcctttactcattactcatttactcactcactaattccttcacctactcattcattcacgcactcatccactactcactcactcatccactcactcatccactcactcgctcattccctcattcattccttactcactcattcactcatttactgactcactaattccttcacctactcattcacccactactcacccactcactcatccactcactcactcatccactcattactcatccactcacttctcatccactcactgattccctcattcattccttcactcactcattcactcatttactcctaattccttcacctactcattcactcactcattcatccactcattcactcactcactctccactcactcacttattccctcattcattccttcactcattggttaaccatgtttatgcatttttcttgcacctccagccctacactaggcccaggggctaaacttcaggggtttgtgcccacctggccccaggggccaaatgagaattaggccaaggctgagctgatgtgctgtgctgaggcaagctggtcttggctggacctgttgggtcacagagatgaaggatctggttctccagtaacccctgctctgcacagtggttctgctccatgacatgccaagcaattctgctggggggcaggatgcctgtgaggactcacagaggggtcctgggggcaggaagacctgggatggaggaccctggctgctggatgtgtggcctgcagggcgtggggggccaccaggtgtgggtggggtctctgatgccccgatgacccccttccctgcagaactgcatgtttgacacctgcactgtgagcggagcgaggactgcctgtgcgccgcgctgtcctcctacgtgcacgcctgtccgccaagggcgtgcagctcggcggctggagggacggcgtctgcagtgagtgcctgccagcccagcccctttccctcgctgggtggccgcgggtcttggggtgcccccagtgtgcacagttgctctaagggcccccgtcctctgtgctgggcttgagggcaaggagcgcccaggtcatgtggccttggacccggccgaggaggggaggggagggtagccgagagggctgggctcaccactgctggctgcccactgccgggctgtgtgtcctgagaatcccctcttcctggcatccgcagcgaagcctatgaccacttgccccaagtcaatgacgtaccactaccatgtcagcactgccagcccacctgccgctccctgagcgagggggacatcacctgcagtgttggcttcatcccgtggatggctgcatctgtcccaagggcaccttcctggacgacacgggcaagtgtgtcaggccagcaactgtccctgctaccacagaggctccatgatccccaatggggagtcggtcacgacagcggggctatctggtaagagctcccgctgtggactgggggggtccctcgcgttcctggcccaggctgaggctctgaccaccatctcctcacagcacctgcacacatgggaactgagctgcatcggaggccaagcccccgccccaggtgagtgccagaaaggaggcactgtgcccccagcctcctcatctctataagaaatcctgaaaaatggcttcagggttagccccacacaagtcagcggggctggtggttgtccatcagctgctcagtgtcaggcatggtttgtgcctctaggcagcaagggggaagaagggagggtgtgggcgcacatatgacactcacacccctcatgcacatgctcacacacccactcatgcacacgctgacacgcccactcatgcacaccacccattcatgcacacactcacactcatgcacatgctcacacacccactcatgcacaccattcacaccctcatgcacacgcactcacacccacttatgcaacactcacacacccactatacacacgcactcacacccactcatgcacacacacccattcatactcatgcacacgctacacacccactcatgcacacacaccgtcatgcacccacactcatgcacacgctcacacaccacatgcacacgcactcacacccactcatgcacacacacccactcatgcacacgcactacacccacttatgcaacactcacacacccacttatggacacgctcacacatccactcatcacatgcttacacacccacacatgcacacacacccactcatgcacacacactcatactctgcacacacactcacacccagttatgcaacgctcacacccactcatggacacgctcacaacccactcatgcacatgcactcacacccactcatgcacacgcacccactcaatgcgcaccacatggcacagacacgtccttccctgaacacgtttgaggcaccgcagcagcctgtggcgggccccctgacggcccctccctccccagtgtgtgctgcgcccatggtgttctttgactccgaaatgccacgcccggggacacaggggctggctgtcagaagagctgccacacactggcatgacctgtgtaagtccctgaggactccccaatgacagaccctccatccgcccctgccgctaagggcgcctgtccccagggtgggcagtggtgagcctctgacacattaggccatggctgccccacgtcccagaggacccctgcccatgcgctcccggactccctggtcctgtggtcctccactgtggtgtgggtgagctgtccctgggaggacctggcaggccccgtgccctgcccatcactcagtggtgtctgctggccctgcagtacagcccccagtgtgtgcctggctgctgtgccccgacgggctggtggcggacggcgagggcggctgcatcactgcggaggactgccctgcgtgcacaatgaggccagctaccgggccggccagaccatccgggtgggctgcaaccctggtatgccgggggctcaaagcccatggggggtgtcaggcccaggaaaccagaggcctccttaaagacgggcgagcccccagcacaggggtcccgggaaaacgcagggcacagactagggctggacgccaccagcagccccagccagggaggcccagtgggcgcgtgtctatggtccaggtccccccaggggtaggaaggctgcacccagtcaggcaggcaccctgtgtgtgcttagcctgacccccagatgtcccccagcacctgtgacagcaggatgtggcggtgcacagagacccctgcctggccacctgcgccgtgtacggggacggccactacctcaccttcgacggcagagctacagcttcaacggagactgcgagtacacgctggtgcaggtgagccggcgcgttggggtcctcacggcggcccccgtggcccgaagctgctcactgcctctctgcggctgcccagggtgcacacaggttgtccccgcctcatcctccttgcgggaaggagggcagggcctgctggtccttgatggcctctgcttccccagaaccactgtggcgggaaagacagcacccagactcctttcgtgttgtcaccgagaacgtcccctgcggcaccacagggaccacctgctccaggccatcaagattttcctgggggtgagcgaggctgggtggtcgcatgccctccaggagctcccatggcagcgtctggtcaggtgggctggggttcttgctgggggccctgagtgacccttgccatgcagggcttcgagctgaagctaagccatgggaaggtggaggtgatcgggacgacgagagccaggaggtgccatacaccatccggcagatgggcatctacctggtggtggaaccgacattggcctggtgctgctgtgggacaagaagaccagcatcttcatcaacctcagcccgagttcaaggtgagaccacgcccctcgtccaggccagggccggctggaaacctggagtggggagcgtggaacaggtgggcagagacgagaggcacagagacacagagagaaacacgagatggaagcggggtgggaagtgggggggacggagccttggcaagggcagcgggtcagagactccttggctgggtgtcagtgttctggggctagagcaaaggcccgcaccctggcggtttgcccgcagcctggacactggaagtccagcagggcatccacagggccgaactctttcgaaggctctgggggctccttttggccccttgcatctgccggggtccccagcgctccttgctgtggccacatcacttggatcgccgccccgtcttcacgcagcctcctccctgtgactggtctaagtttccctcttttataaggacaccaggcattggattcaggacccactcattactcagtctgcaagaccccatctcccagtgaggtgccatgcataggcgccggggtcaggactaggcgggtccttcgaggccacgtcagcttctttttctccaggaggggcttgcctctggtccggccctcggtgctcagctgcactgcccggggcctccccaggtgtagctggaggtggaaggaggaagcagcacctgtggtcgctgttggccacctgggtgggaggaggcggccgcaggcagggtggccctgggtgggaggaggcggcctaggggcagggtggctctggccttctcgtttgctgcacccacctccacctctcccggtgcctctgcagggcagggtctgcggcctggtgggaacttcgacgacatcgccgttaatgactttgccacgcggagccggtctgtggtggggacgtgctggagtttgggaacagctggaagctctccccctcctgcccagatgccctgcgcccaaggacccctgcacggccaaccccttccgcaagtcctgggcccagaagcagtgcgcatcctccacggccccaccttcgccgcctgccacgcacacgtatgctggccggggggctttctctgggcccaagggggtcatggtgacccaaggagcccccagaagggagaagggaaggggtctgggagacagctgccaaccaagggtgtgggctgctgggactggcgctggtatgactcgcctagaggggctgggcttccagctctgacacctgtcagctatggtttcggggcctggggggtgttaaccccaagggctgccgaggaagccccaggcactgtggatatccagatggcccagccggccacttggggatgggcattcgccctccctgagctccactggaactcggcccggtcaatgtgccagcatgggcccggtccccaagagcccgcggggtgggtgggggggccctggaacctgaagccccgtctccctcaggtggagccggccaggtactacgaggcctggtgaacgacgcgtgcgcctgcgactccgggggtgactgcgagtgcttctgcacggctgtgccgcctacgcccaggcctgccatgaagtaggcctgtgtgtgtcctggcggaccccgagatctgccgtgagtgcgagtgggcacctggggaagaacaggaagcgccggcagcgtgtgcccaccacactcgccgctgatgcgtggggtgtggggcgggtggggaaggtttccaaataacagaaacacctgggcccagagaggagggcgtggctgacagaggggtccctggcatggtaaacgttctgggcagaggggtcagcagagctgcccagctctagagaggagggcgtggctgcagaggggtcgctggcatggtagaacattctgggcagaggggtcagcagagttgcccagtctagagaggagggcgtggctgatggaggggtccctggcatggttgggcagagggttcacagagctgcccagctctagggaggagggcgtggctgacggaggggtccctggcatggttggcagagggttcagcagagctgcccagctctagggaggagggcgtggctgacgggtcgcggcgtggtagaacgttctgggcagtggggtcagcagagctgcccagctctagcccacacgagccttgccgggaacgggcactgctggatctgctctgactggagaccccactctggtgcagcctccgtggcaccctgataattggggggtcccgatctggcccaccctcccctgtcccatcttgtgatggccgggaggtgcaggggagggaagcagctttagaacagccctggggttggggcctctgcgagtgagttcctgggaccccaccgagcccttccttcctccctgcagcctgttctgcgactactacaaccccgaaggccagtgcgagtggcactaccagccctgcgggtgccctgcctgcgcacctgccggaacccccgtggagactgcctgcgggacgtccggggctggaaggtgggctggggccggtcgggaggggtggcctgggctccgccgcctgtggcctctcctggcccctcgaggagcctctgtggccccagcttccagcacattctggtgctgtcgcgaggcccgctgcttgggggctgggcggagccctccagagcgaggtggacgacactcggctggttgtgactctggcctctttggcccacaggctgctaccccaagtgcccaccagaggtcccatctttgatgaggacaagatgcagtgtgtggccacctgcccaaccccgcctctgcaccacggtgccacgtccatgggaagtcctaccggccaggtgcagtggtgccctcggacagaactgccagtcctggtgagtcctttggggggaggaatatggagcctgcagcatgcagggaatttgaccacggcctgggctttgggtggggctgggagcggcagggctggggacctcccgttactggagttgaagcttgggtcctgtcctggcccaggcatctgtgacatcagcttccagggaccagcacccccatgtcctgagtccccagaggcgggactgggtgtagggctccttgggcagaaaaccagcacaacctctggggagcaggctcgaggggctcagggggcggcaggggaagctgggccgagatggagccctagggtccccaccggaaggatgcccattaaaatccccctggaaagtaatggctccactctggcacccacctcccctgacccccgactggagggccccacgagggagggaccttgggctgacgctggagagacaactgctgggacccaggtgggccggcctcctgtcccccagtctgggggtgcaatgcagttcccagggaactccaccccttcggagctgctccctgcccgccgttggtagcatgggatgcccgtggaaggcacaaggcccccccacgcatcggcctgcccttcttccttgtctccagcctttgtacggagcgcggcgtgagtgcacctacaaagctgagggtgagcggccggcagcccctggggctggggtccggggtctctgtctgcgcccagcctctgacgggcctgggccctccgtccccatagcctgtgtctcacctacaatggacagcgcttccacccaggggacgtcatctaccacacgacggatggcagggtggctgcatctccgcccgctgcggggccaacggcaccattgagaggagggtctaccctgcagccccaccacccctgtccccccaaccaccttctccttctccacacccccgcttgtaaggcaaatgcggccgaggagccccagggtgagcccctcccactgcctggcacagctgccttgctggacgctgaggtcacagcagctctgggcatgggcggcagcccctgaggatcagaagggatcgaggagcagggagtcgggctcggggatgacctgctgtttccccaccagcccctgcagtggggagggcctggcctccaagtcaccccagcaggcctggcgtccaagtcctccctcagcagcccccgggcctggcctcatgggggtgtcaggggtctggcagcccaggctgccccggggatgcatggctatcacttgcctcacactgctcagggctcaggtacccccattcctcgccctcttctgggggatgtctcagggccccaaggcatcatctgagcttctctgaagtagaaagctctggaactcacgtgttctggggcacagatgtgtggaccctgctcagggatggcctgggagccacttccctaaaactcagtcggttcgcctggctcttcagaacctgtccgctcatgtgggttctgagcagggaccgcgggtggggacaggaagtcagacctgctgggcagctccagaccggtgacagagccgcagggaggggcggggcggcccccaagtgcgggctctcatgctcagctgccttctcttctgcccacagtcgtgagctccacgcacacccccagaatggcccaagcagcgcgcacacaggccctccgagcagcgcctggcccaccacagcaggacttctcccaggacgaggctgcccacagcctctgcctcactgccgccggtctgtggggaaagtgcctgtggtcgccatggatggatgtcagccgccctggacggggcacggacagcgggacttcgacacactggagaacctccgcgcccatgggtaccgggtgtgcgaatcacccagtcggtggagtgccgagctgaggacgcccccggagtgccgctccgagccctggggcagcggtgcagtgcagcccggatgtggggctgacctgtcgtaacagggagcaggcatcggggcttgctacaactaccagatcagggtccagtgctgcacgcccctagcctgctccacctctagagtccagcccagaccactcctccaactacctccaagaccactgaaacccgggcctcaggtcctcagctcccagcagcacacctggcaccgtgtctctctctacagccaggacgacaccgccccaggtaccgctacctctgtcaaaaaaactttctcaactcccagccctccgccagtccggcaacatcaacatcatccatgtcgaccacgaccccggggacctctgtggtctccagaagcccaccctcacggagcccagcacatcctcctgcctgcaggagctttgcacctggacgagtggatcgatggcagctaccctgctcctggaataaatggtggagattttgacacattcaaaatttgagagacgaaggatacacattctgtgaaagtcctcgaagcgtgcagtgccggcagagagcttccccaacacgccgctggcagacctggggcaggacgtcatctgcagccaacagaggggctgatttgcctgaacaagaaccagctcccacccatctgctacaactatgaatccgcatccagtgttgcgagacggtgaacgtgtgcagagacatcaccagaccgccaaaaccgtcgcaacgacacggccgactccacatccaaccggagctcagacccagaccaccttaccacacacatgccctcggcctccacagagcaacccacggcaacctccaggggtgggccacagcaaccagcgtcacacagggcacccacaccacaccagtcaccagagactgtcatcccggtgcacctggacaaagtggttcgacgtggacttcccgtcccccggaccccatggtgggacaaggaaacctacaacaacatcatcaggagtggggaaaaaatctgccgccgacctgagagatcaccaggctccagtgccgagccaagagccacccagaggtgagcatcgaacacctggccaggtggtgcagtgcagccgggaagagggcctggtgtgccggaaccaggaccagcaggacccttcaagatgtgcctcaactacgaggtgcgtgtgctctgctgcgagacccccagggctgccacatgacctccacacctggctccacctctagcagtccagcccagaccactcctcaacaacctccaagaccactgaaacccaggcctcaggctcctcagcccccagcagcaccctggcaccgtgtctctctctacagccaggacgacacctgccccaggtaccgctacctcgtcaaaaaaactttctcaactcccagccctccgccagtgccggcaacatcaacatcatcatgtcgaccacggccccggggacctctgtggtctccagcaagcccacccccacggagccagcacatcctcctgcctgcaggagctttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacctctggtcctggaatactccaagccctgttcccagcaccagtacaacctctgctgctacaaccagcacaaccttgctcctacaaccagaacaacatctgctcctacaagcagcatgacctctggtcctggaatactcccagccctgttcccaccaccagcacaacctctgctcctacaactagcacaaccttggtcctggaactactcccagccctgttcccaccaccagcacaacctctgctcctacaacagcacaacctctggtcctggaagtactcccagccctgttcccaccaccagcacaaccttgctcctacaaccagcacaacctctgcctctacagccagcacaacctctggtcctggaatactcccagccctgttcccaccaccagcacaacctctgctcctacaaccagaacaaccttgcctctacagccagcacaacctctggtcctggaagtactcccagccctgttcccaccacagcacaacctctgctcctacaaccagaacaacccctgcctctacagccagcacaaccttggtcctggaactactcccagccctgttcccaccacaagcacaacctctgcttctacaacagcacaatctctccccttacaaccagcacaacctctgctcctataaccagcatgaccttggtcctggaactactcccagccctgttcccaccaccagcacaacctctgctcctacaacagcacaacctctgcctctacagccagcacaacctctggtcctggaactactcccagcctgttcccaccaccagcacaacctctgctcctacaaccagcacaacctctgcctctacagcagcacaacctctggtcctggaacttctctcagccctgttcccaccacgagcacaaccttgctcctacaactagcacaacctctggtcctggaactactcccagccctgttcccaccacagcacaacctctgctcctacaaccagcacgacctctggtcctggaactactcccagcccgttcccaccaccagcacaacccctgtttcaaagaccagcacaagccatctttctgtatcaagacaacccactcccaaccagtcaccagtgactgtcatcctctgtgcgcctggacaagtggttcgacgtggacttcccatcccctggaccccacggcggggacaaggaaacctacacaacatcatcaggagtggggaaaaaatctgccgccgacctgaggagatcaccaggctccgtgccgagccgagagccacccggaggtgaacattgaacacctgggtcaggtggtgcagtcagccgtgaagagggcctggtgtgccggaaccaggaccagcagggacccttcaagatgtcctcaactacgaggtgcgcgtgctctgctgcgagacccccagaggctgcccggtgaccttgtgaccccatatgggacttctcctaccaatgctctgtatccttccctgtctacttccaggtatccgcctccgtggcatccacctctgtggcatccagctctgtggcatccagctctgggcttactccacccaaacctgcttctgcaacgtggctgaccggctctaccctgcaggttgtgagtgtttctggtgcaattgtttctgagctcaccctggtcagttttttatccaggaagccaagctgtgatgatgataggagtctctgctctttgtggcacaggctcattgtcacaggtggctgctggcattctctgaaattttttcccattacacaggtggtagaaagtgccccttggctctgggagttttttgcttctcctttgagcaggactccactaaaggctgccatgtccttcctcttacaggatccaccatataccgccacagagacctcgctggccattgctattagccctgtgtagccaggactgccaagtggtcagaggggttgacagtgactgtccgtccacacgctgcctcctgccccagccacgtccccttcaatatccacctccgagcccgtcactgactgggatgcccaaatgcggttccccccagaaaggtaaccccctacttctcacccttctgaggctcaggggctcctacagggaacttgaatgtctttgcaattagtcttcagctgcaaatcttgagaaggtcactggcgctagtggaggcagcccggccgtcaggagagggccatgcttagcccggcgtctctgatcaccctgggcttcccaggcacgtgctttccagacactgggttgtggggccgaaggctgaggctgtgctgaggacagccagggccagagcaggtggatgagctgcacagccagggagtgtggcagagccagggaggagccactcccacaccagaggccccgccccgggccagctcggtgtctggggtgggtgctgagggtggggcaggaaggaaactgggcacagccaccctcccctgtccccacacgggactctcgggactgtgaccccgagaaccaggggtgccccggagatcgggagaggccggaccctgcaggtctctgtgcttctgcagaaagtgagacctgggccacacccaactgctccgaggccacctgtgagggcaacaacgtcatcccctgcgcccgcgcacgtgcccgagggtggagaagcccacttgtgccaacggctacccgctgtgaaggtggctgaccaagatggctgctgccatcactaccagtgccagtgtgagtgggcgccgagcgggacccagggcagccggggcagccactccccacccaggtggaaatgggcgggcagaggagggggcttggctgaagcagaaaagaattgggtgggacagcaggaaggactcccagcatcaaggcggggccgcatggggccgagcctccccgcttaggggtgctgagtgatccctgtgagcctcggagcagcctggctggagaaggtggaggagtctgtccctgcctcctccagccttgtcaagcgcccgctggatggagctctgtgcggacgctggccacgtgtgtctgatgacgtgagggtcttgtgcgccctgtgagatgagacggtggggggtcagggacagtgtgacctgttgggaggaagccccagggccatggtgccaccacccgagccacccgtaagctgcccctggggcctggcaggtgtgtgcagcggctggggtgacccccactacatcacctcgacggcacctactacaccttcctggacaactgcacgtacgtgctggtgcagcagattggcccgtgtatggccacttccgcgtgctcgtcgacaactacttctgcggtgcggaggacggctctcctgcccgaggtccatcatcctggagtaccaccaggaccgcgtggtgctgaccccaagccagtccacggggtgatgacgaacgaggtgggggcgcgcccggtgtgccgcggaggggtgggggacgcggctttcccggcaagagcctgagcagcggctgaccgcccgcccgccgccttctgacttcccgtcgaccacgccctgcgtccagatcatcttcaacaacaaggtggcagccccggcttccggaaaaacggcatcgtggtctcgcgcatcggcgtcaagatgtacggaccatcccggagctgggagtccaggtcatgttctccggcctcatcttctccgtggagggcccttcagcaagtttgccaacaacaccgagggccagtgcggtgaggccacagggctccgggcatcgtctggcattcgcgggggcgggggtgccgggcaggggcgaggccaccacgtgcgcgtgtgccggtg

SEQ ID NO: 5021 - DNA, 20865 bp, Homo sapiens
  misc_feature (4581)..(4943): n is a, c, g, or t
aataaacagaaacacctgggcccagagaggagggcgtggctgacagaggggtccctggctggtagaacgttctgggcagaggggtcagcagagctgcccagctctagagaggagggcgggctgacagaggggtcgctggcatggtagaacattctgggcagaggggtcagcagagttcccagctctagagaggagggcgtggctgatggaggggtccctggcatggttgggcagaggttcagcagagctgcccagctctagggaggagggcgtggctgacggaggggtccctggctggttgggcagagggttcagcagagctgcccagctctagggaggagggcgtggctgacggtcgctggcgtggtagaacgttctgggcagtggggtcagcagagctgcccagctctagccacacggagccttgccgggaacgggcactgctggatctgctctgactggagaccccacttggtggcagcctccgtggcaccctgataattggggggtcccgatctggcccaccctccctgtccccatcttgtgatggccgggaggtgcaggggagggaagcagctttagaacagcccggggtgtggggcctctgcgagtgagttcctgggaccccaccgagcccttccttcctcccgcagctctgttctgcgactactacaaccccgaaggccagtgcgagtggcactaccagcctgcggggtgccctgcctgcgcacctgccggaacccccgtggagactgcctgcgggacgtcggggcctggaaggtgggctggggccggtcgggaggggtggcctgggctccgccgcctgggccttctcctggcccctcgaggagcctctgtggccccagcttccagcacattctggtgtgtcggcgaggcccgctgcttgggggctgggcggagccctccagagcgaggtggacgacctcggtctggttgtgactctggcctctttggcccacaggctgctaccccaagtgcccacagaggctcccatctttgatgaggacaagatgcagtgtgtggccacctgcccaaccccgctctgccaccacggtgccacgtccatgggaagtcctaccggccaggtgcagtggtgccctggacaagaactgccagtcctggtgagtcctttggggggaggaatatggagcctgcagcagcaggggaatttgaccacggcctgggctttgggtggggctgggagcggcagggctggggcctccccgttactggagttgaagcttgggtcctgtcctggcccaggcatctgtgacatcgcttctcagggaccagcacccccatgtcctgagtccccagaggcgggactgggtgtaggctcctctgggcagaaaaccagcacaacctctggggagcaggctcgaggggctcagggggggcagggggaagctgggccgagatggagccctagggtccccaccggaaggatgcccattaaatcacccctggaaagtaatggctccactctggcacccacctcccctgacccccgactgaggggccccacgagggagggaccttgggctgacgctggagagacaactgctgggacccggtggggccggcctcctgtcccccagtctgggggtgcaatgcagttcccagggaactcccccctgtcggagctgctccctgcccgccgttggtagcatgggatgcccgtggaaggcacaggccgcccccacgcatcggcctgcccttcttccttgtctccagcctttgtacggagcgggcgtggagtgcacctacaaagctgagggtgagcggccggcagcccctggggctggggtcgggggtctctgtctgcgcccagcctctgacgggcctgggccctccgtccccatagccttgtctgcacctacaatggacagcgcttccacccaggggacgtcatctaccacacgacggtggcacgggtggctgcatctccgcccgctgcggggccaacggcaccattgagaggagggctacccctgcagccccaccacccctgtccccccaaccaccttctccttctccacaccccgcttggtaaggcaaatgcggccgaggagccccagggtgagcccctcccactgcctggcaagctgcccttgctggacgctgaggtcacagcagctctgggcatgggcggcagcccctgagatcaagaagggatcgaggagcagggagtcgggctcggggatgacctgctgtttccccacagccacctgcagtggggagggcctggcctccaagtcaccccagcaggcctggcgtccagtcctgccctcagcagcccccgggcctggcctcatgggggtgtcaggggtctggcagccaggctggccccggggatgcatggctatcacttgcctcacactgctcagggctcaggtaccccatgtcctcgccctcttctgggggatgtctcagggccccaaggcatcatctgagctttctgagagtagaaagctctggaactcacgtgttctggggcacagatgtgtggaccctgccagggcatggcctgggagccacttccctaaaactcagtcggttcgcctggctcttcagacctgtgccgctcatgtgggttctgagcagggaccgcgggtggggacaggaagtcagaccgctggcgcagctccagaccggtgacagagccgcagggaggggcggggcggcccccaagtcgggcctctcatgctcagctgccttctcttctgcccacagtcgtgagctccacgcacaccccagcaatggcccaagcagcgcgcacacaggccctccgagcagcgcctggcccaccacgcaggcacttctcccaggacgaggctgcccacagcctctgcctcactgccgccggtctgggggaaaagtgcctgtggtcgccatggatggatgtcagccgccctggacggggcacggaagcggtgacttcgacacactggagaacctccgcgcccatgggtaccgggtgtgcgaatccccaggtcggtggagtgccgagctgaggacgcccccggagtgccgctccgagccctgggcagcgtgtgcagtgcagcccggatgtggggctgacctgtcgtaacagggagcaggcatcgggctctgctacaactaccagatcagggtccagtgctgcacgcccctagcctgctccactctagcagtccagcccagaccactcctccaactacctccaagaccactgaaacccgggctcaggctcctcagctcccagcagcacacctggcaccgtgtctctctctacagccaggacacacctgccccaggtaccgctacctctgtcaaaaaaactttctcaactcccagccctccccagtgccggcaacatcaacatcatccatgtcgaccacgaccccggggacctctgtggttccagcaagcccaccctcacggagcccagcacatcctcctgcctgcaggagctttgcactggaccgagtggatcgatggcagctaccctgctcctggaataaatggtggagattttgaacatttcaaaatttgagagacgaaggatacacattctgtgaaagtcctcgaagcgtgcatgccgggcagagagcttccccaacacgccgctggcagacctggggcaggacgtcatctgagccacacagaggggctgatttgcctgaacaagaaccagctcccacccatctgctacaatatgagatccgcatccagtgttgcgagacggtgaacgtgtgcagagacatcaccagaccccaaagaccgtcgcaacgacacggccgactccacatccaaccggagctcagacccagacaccttcaccacacacatgccctcggcctccacagagcaacccacggcaacctccagggggggcccacagcaaccagcgtcacacagggcacccacaccacaccagtcaccagagactgcatccccggtgcacctggacaaagtggttcgacgtggacttcccgtcccccggaccccaggtggagacaaggaaacctacaacaacatcatcaggagtggggaaaaaatctgccgccgcctgaggagatcaccaggctccagtgccgagccaagagccacccagaggtgagcatcgacacctgggccaggtggtgcagtgcagccgggaagagggcctggtgtgccggaaccaggacagcagggacccttcaagatgtgcctcaactacgaggtgcgtgtgctctgctgcgagaccccagaggctgccacatgacctccacacctggctccacctctagcagtccagcccagacactccttcaacaacctccaagaccactgaaacccaggcctcaggctcctcagcccccagagcacacctggcaccgtgtctctctctacagccaggacgacacctgccccaggtaccgcacctctgtcaaaaaaactttctcaactcccagccctccgccagtgccggcaacatcaactcatccatgtcgaccacggccccggggacctctgtggtctccagcaagcccacccccacgagcccagcacatcctcctgcctgcaggagctttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacctctggtctggaactactccaagccctgttcccagcaccagtacaacctctgctgctacaaccagcaaacctctgctcctacaaccagaacaacatctgctcctacaagcagcatgacctctggtctggaactactcccagccctgttcccaccaccagcacaacctctgctcctacaactagcaaacctctggtcctggaactactcccagccctgttcccaccaccagcacaacctctgctctacaaccagcacaacctctggtcctggaagtactcccagccctgttcccaccaccagcaaacctctgctcctacaaccagcacaacctctgcctctacagccagcacaacctctggtctggaactactcccagccctgttcccaccaccagcacaacctctgctcctacaaccagaaaacctctgcctctacagccagcacaacctctggtcctggaagtactcccagccctgttccaccaccagcacaacctctgctcctacaaccagaacaacccctgcctctacagccagcaaacctctggtcctggaactactcccagccctgttcccaccacaagcacaacctctgctttacaaccagcacaatctctccccttacaaccagcacaacctctgctcctataaccagcagacctctggtcctggaactactcccagccctgttcccaccaccagcacaacctctgctctacaaccagcacaacctctgcctctacagccagcacaacctctggtcctggaactactccagccctgttcccaccaccagcacaacctctgctcctacaaccagcacaacctctgccttacagccagcacaacctctggtcctggaacttctctcagccctgttcccaccacgagcaaacctctgctcctacaactagcacaacctctggtcctggaactactcccagccctgttccaccaccagcacaacctctgctcctacaaccagcacgacctctggtcctggaactactccagccccgttcccaccaccagcacaacccctgtttcaaagaccagcacaagccatcttttgtatccaagacaacccactcccaaccagtcaccagtgactgtcatcctctgtgcgcctgacaaagtggttcgacgtggacttcccatcccctggaccccacggcggggacaaggaaactacaacaacatcatcaggagtggggaaaaaatctgccgccgacctgaggagatcaccagctccagtgccgagccgagagccacccggaggtgaacattgaacacctgggtcaggtgggcagtgcagccgtgaagagggcctggtgtgccggaaccaggaccagcagggacccttcagatgtgcctcaactacgaggtgcgcgtgctctgctgcgagacccccagaggctgcccgggacctctgtgaccccatatgggacttctcctaccaatgctctgtatccttccctgtctattccatggtatccgcctccgtggcatccacctctgtggcatccagctctgtggcatccactctgtggcttactccacccaaacctgcttctgcaacgtggctgaccggctctaccctgaggttcgtgagtgtttctggtgcaattgtttctgagctcaccctggtcagttttttatcaggaacgccaagctgtgatgatgataggagtctctgctctttgtggcacaggctcattgcacagagtggctgctggcattctctgaaattttttcccattacacaggtggtagaaagtcccctctggctctgggagttttttgcttctcctttgagcaggactccactaaaggctgcatgtcccttcctcttacaggatccaccatataccgccacagagacctcgctggccattgtattatgccctgtgtagccaggactgccaagtggtcagaggggttgacagtgactgtcctccaccacgctgcctcctgccccagccacgtccccttcaatatccacctccgagcccgtactgagctgggatgcccaaatgcggttccccccagaaaggtaaccccctacttctcaccttctgaaggctcaggggctcctacagggaacttgaatgtctttgcaattagtcttcagcgcaaagtcttgagaaggtcactggcgctagtggaggcagcccggccgtcaggagagggcatgctgtagcccggcgtctctgatcaccctgggcttcccaggcacgtgctttccagacatgggtgtgtggggccgaaggctgaggctgtgctgaggacagccagggccagagcaggtgatgaggctgcacagccagggagtgtggcagagccagggaggagccactcccacaccagagcccctgccccgggccagctcggtgtctggggtgggtgctgagggtggggcaggaaggaactggggcacagccaccctcccctgtccccacacgggactctcgggactgtgaccccgaaaccaaggggtgccccggagatcgggagaggccggaccctgcaggtctctgtgcttctgagaaaggtgagacctgggccacacccaactgctccgaggccacctgtgagggcaacaactcatctccctgcgcccgcgcacgtgcccgagggtggagaagcccacttgtgccaacggcacccggctgtgaaggtggctgaccaagatggctgctgccatcactaccagtgccagtgtagtggagcgccgagcgggacccagggcagccggggcagccactccccacccaggtggaatgggcggggcagaggagggggcttggctgaagcagaaaagaattgggtgggacagcaggaggacttcccagcatcaaggcggggccgcatggggccgagcctccccgcttaggggtgcgagtgaatccctgtgagcctcggagcagcctggctggagaaggtggaggagtctgtcccgcctcgctccagccttgtcaagcgcccgctggatggagctctgtgcggacgctggccactgtgttctgatgacgtgagggtcttgtgcgccctgtgagatgagacggtggggggtcaggacagatgtgacctgttgggaggaagccccagggccatggtgccaccacccgagccaccgtaaggctgcccctggggcctggcaggtgtgtgcagcggctggggtgacccccactacacaccttcgacggcacctactacaccttcctggacaactgcacgtacgtgctggtgcagcgattgtgcccgtgtatggccacttccgcgtgctcgtcgacaactacttctgcggtgcggggacgggctctcctgcccgaggtccatcatcctggagtaccaccaggaccgcgtggtgcgacccgcaagccagtccacggggtgatgacgaacgaggtgggggcgcgcccggtgtgcccggagggggtgggggacgcggctttcccggcaagagcctgagcagcggctgaccgcccgccgcctgccttctgacttcccgtcgaccacgccctgcgtccagatcatcttcaacaacaggtggtcagccccggcttccggaaaaacggcatcgtggtctcgcgcatcggcgtcaagagtacgcgaccatcccggagctgggagtccaggtcatgttctccggcctcatcttctccgggaggtgcccttcagcaagtttgccaacaacaccgagggccagtgcggtgaggccacaggctcccgggcatcgtctggcattcgcgggggcgggggtgccgggcaggggcgaggccacacgtgccgcgtgtgccggtgtctctgctttctggctgctctgctgagtgcaggccacagcatgaggcttacgcctgccggtacctgcagctccccagtaccatagggactgtcccaggttgttctcgggggacagtgaggcacaggcagggcccgctgcagttcaccaagttgtgacctgagacaccagggtcctgtcccccagctgggggtggggccagccggctctgctgtccacagcctgacccccaccgcgtctgcccaggcacttgcaccaacgacaggaaggatgagtgcgcacgcctagggggacggtggtcgcttcctgctccgagatgtccggcctctggaacgtagcatccctgaccagccagcctgccaccggcctcacccgacgcccaccacggtcgggccaccacagttgggtctaccacggtcgggcccaccacagttgggtctaccaccgtcgggccaccacaccgcctgctccgtgcctgccatcacccatctgccagctgattctgagcaagtggacttgggtgcaagggagggagggtcagtgtggccgccccacctcccacccttccaaggctggaggggaagaagcgcattttcagggggctcctgagaggaaacgagagctgctggtacacagaccaaggaggggcgggtgccgggaaggggtggttgtggctggaatgctgccaagggtcaccagggttggccggctgggcgtctctgaggctctctgctggctcaggtgtatggcgggggcatcggtcaccacccccaggcagcttccaggtttgcagggcaggggctggggggccaggaagaacttgcagaaataaatggatgatgccatctggacccccaccccccgccccaagcacacagaatgtgtggaaggagccgtccggggatacaggagggcggccacacaccgtggctgctctgggactcgcctcgcctggagactgccctgaagcctgggagcctgacgtgagcaggcaggtggccggagaggctgcacccagcaccccgcccatccctcccacagggttttgagccgtgccacactgtgatccccccactgctgttctatgagggctgcgtctttgacggtgccacatgacggacctggatgtggtgtgctccagcctggagctgtacgcggcacttgtgcgtcccacgacatctgcatcgattggagaggccggaccggccacatgtgccgtgatgccaccactgtcctcagggtcccaagtcgcttgtgaggggcacaggcacgccggacggccaacagggtgggctcgggcagtcagggggggacctggaggaggagggggcagccccaggcagagtgcacccagttccctggagagaagggagggcgtccacgtctgggagcccgtggggggcactggggtgtgggaggccgtagccaggcccaggcccacaggtggctgcgggcagtccggagcagatgttggtgcccagcggcccgcgttgctctgggtgggtgccctcccacctctcaggtgtggcttcccctccccacagcattcacctgcccagccgacaaggtgtaccaccctgcggcccgagcaacccctcctactgctacgggaatgacagcgccagcctcgggtagcaccctccctcctggccctgccatgggctgctggagccacccagtccccagcctcccgtgcatctcccactcccaggctggggtccttctcaccggagggaaaaaggagacccaccaccctatgctctctacagggctctgccggaggccggccccatcaccgaaggctgcttctgccggagggcatgaccctcttcagcaccagtgcccaagtctgcgtgcccacgggctgcccagtacgtgccccaggccggggctggggggtgtggcaggactgggcctgtgactgttggcaggtcctggggtctaccctggccccaatatgggaccctgcctctcgcccctattgtggtgctgacccccagtaacctcagatctctctccttccagggtgtctggggccccacggagaccggtgaaggtgagtggaaggcatggcccaagagggcactggggtccaagagcccgagggggaggctcttgaaacaccggccccagaaatggtcaggtggggctcaggggtcggggtgcctctctgtgtcagaggcccagagaaagggctgcgggaggagccgggctcccagaaagatcgggatctcccttcccaggtacccactctgtccgtattggggacggtgccggggcgtcgtcctggtgttgctctgtgggtgggtgctggccccgaggctggctgtgctcttcccttcttgggacgccccttctgcccagccaagactgtggaggtgtgaggtggggggcgcaggccgtcaccccacagcctgcccaccttgcagagctttgtgcccatccctgggccctaccctgacttttgaagccctactcctgctgggtcctcagtgcaggccacacggcctccacacctgctgccccagcactgcatgagccgggctggctgctgcacccctgggtggagccgctgcggcgctggacctcagtccccttccttgcaggtgggccacaccgtcggcatggactgccagggtgcacgtgtgaggcggccacgtggacgctgacctgccgacccaagctctgcccgctgcccctgcctgccccctgcccggcttcgtgcctgtgcctgcagccccacaggccggccagtctgcccccagtacagctgcggtaagccctttgctgggtgaggggcatggtgtggcaggcggtgacccggagcccactcggcccggactttgctgctgccttggggcgtgcacctggggcagtgcctacgagggcgtcccctcctccgcttccgcaacagcctcatctggagacccccagcgggctgtctaggcggtccgcaatcctagagaccccagggggtgggccttcgggtggggcgggggacagactcctaattgcctcactcctgcccccgcagcctgcaacaccagccgtgccccgcgcccgtgggctgtcctgagggcgcccgcgcgatcccgacctaccaggaggggcctgctgcccagtccaaaactgcagtgagtggcctggaccaggccctgtcaggggccggggctggggtctccacctgggattttggggggccataaccagatgccagtgcggcttgtcactgcgggtctgtggctctggactgagccttccgcagagatgaggctggacaaaccccgtggcgagcccgggaatgaggcgcccaggaggctgcaggggcgggaatgctgagggtgagggagagtgggcggcggggggtgcagctgcttgtcttctcgtgggcaggctggacagtggcagcatcaacgggaccctgtaccaggtaagagccacggagctcagaccccctcagccaagggacggagcttcccactgaccctgaggcccaggtagactttggagcaactgccaactcggccggggccagggactcgagtctctgcagacacagcccactatcaagtgtggctgagcccgaggtcggccccaggtcccggaaatatggacatctacaccctggcctgcctggctcggggggctccgggggactttgcctctcctggcaccacagcacagccaggcctggatccccggctctgtcctgagccggctgagtatgtggccctgcagagtgtgtggccttgttgggcccccatccaagggggtgcagcgtggggctctgctctagggatggggaccctgggctgtgcctctgcaccaagaggtgccaccacgagtcaccccaggggtgcaactcggcctggtaggagcggcctggagggggatgtctgggaagttgggggcagcaagccagtggggaggcagggcgggtctccccagggcccaagctcatgagtgtctgctgccctggctctccccagcccgggccgtggtctcctcgagcctgtgcgaaacctgcaggtgtgagctgccgggtggcccccctcggacgcgtttgtggtcagctgtgagacccagatctgcaacacacactgccctgtggtagcgctcccaccctgccccgaccctgccctggctcttggggggcagcggtcgcctggatccagccacatgtccatccctcccgcagggcttcgagtaccaggagcagagcgggcagtgtgtggcacctgtgtgcaggtcgcctgtgtcaccaacaccagcaagagccccgcccacctttctacgtgagtagtggctgccacaaagaggaagggcagggtctgggagcactggggcagtggggacctgtcgttgccaggcatgcgtctggcagaggctggggactctctggaagccacgggctggggtgcagacagagggacagacggagggagggtcactcaccccggggcctgcctccctccagcctggcgagacctggtcagacgcagggaaccactgtgtgacccaccaggtgagaagcaccaggatgggctcgtggtggtcaccacgaagaaggcgtgccccccgctcgctgttctctggtgaggtccaggatccccgctccagccaaggggggcttcacccctagagggtttggggggctgtgatcatccctgcagcgccagcagacaccccctcctgcttggggtgtccactcctgagcctggccccatgtccccatccctcacttctgtgggggccgccgaggcctcggcactgagggcgcccctctgtcggcacaggacgaggcccgcatgagcaaggacgctgctgccgcttctgcccgccgcccccgcccccgtaccagaaccgtgagtgcccagccgctgggcggggcgggctccaccctcagaggtccaggagcagctgggctggtcctaaacctgtgttcctctccagagtcgacctgtgctgtgtaccataggagcctgatcatccagcagagggctgcagctcctcggagcccgtgcgcctggcttactgccgggggaactgtggggacgctcttccatgtacgtgcctgggcagcaggcagggagacgcgattggctgtggggtgcatcagggcccccagggctctaggtgccagatagacgaggggcaggaccatgaggggccagcaaagggctctgagggtgaggcgggaaaggggtcctgagatggcaagggtggggctgggtaactacatccccagagcctgtgtcggcatcacgctctcctgtttactgagctccgccagaacttgccgcagccgccccgagtctccctccctcccatcagcacggagccggggtcggcctggtgggactgttggcgcctggggaactggcaaaggagagctggttgtcagacactgcagcatgcctccaggagcagggaacacgatgaggccgcccagagctcggcacggcgccgcttacggcaggaggctggggtggcgcagcagctggtgctgagcagcccctgcccacaggactcgctcgagggcaacacggtggagcacaggtgccagtgctgccaggagctgcggacccgctgaggaatgtgaccctgcactgcaccgacggctccagccgggccttcagctacaccaggtggaagagtgcggctgcatgggccggcggtgccctgcgccgggcgacacccagcaccggaggaggcggaacccgagcccagccaggaggcagagagtgggagctgggagagaggctcccagtgtcccccatgcactgaccagcactgccgccctcctgacctccaaggagaacccccatatgtcctctgagctcggcttccaaggccagtggaacttgtgcccctgtccaggcgctgcagctttgaacacactgtccacgcccgctttcttgtggagggtgtgggctatgggcacctgctgcctggaggaggggcccttacccaccccgcctgcagccacctctcaggaccgccccggggctggccgagctcctctggccatgcatccagcctgctgttctggggacgtggcatcacctgagggtctcaggaatgacgcttggacatggtgatcagctgcctggtggctcaggaggaagaacctcactcctacctcagccctcagcctgcgctcccctcctcagtacaggccaatctgttgcataaatacacttgagcattttgcaatttgtggactgtgcatttttgagattgttcataaaatccaggaatagggtgggggcaaacccgggccctgtggggtgcaacctcaggccagccacccagtactgggcagccctgctgcttctgtgggctggctgggacgtgtctctctgctcagagaggagaggccagagcttggatctgccccaagaagagaccacaccctgcagaggtctttgagggcttggctgcagtctagagtccaggatgcatctgttcaaacacagagagtgagtgaatgagagtgagagaatgaatgagtgaataaatgggtgagtgataagtgagtgcatgagtgagtgaatgaataagtgaatgtgtgagtgagtgcatgtgaggagtgaatgtgagtgaatgaatgtgagtgaataagtgagtgactgagtgaatgagtgaagaatgagtgaatgagtgagcaaataagtgaatgagtgagtgaataagtgaatgcatgaggaatgaataagtgaatgtgtgagtgaatgagtgcatgtgagtgaataagtgagtgcatggtgagtgaatgaataagtgaatgtgtgagtgaatgagtgcatgtgagtgaataagtatggagtgagagattgagtgaatgagtgaatgaatgagtgaatgagtgagcaaatgagtgaaaaatgaatgagtaaatgagtgggtgaatgaacaagtgaatgagtgaatgagtgaatgaggagcaaatgagtgagtgaataaatgaatgagtaaatgagtgggtgaatgaacaagtgaagagtgagtgagcgaatgggtaagtgaatgagcgaatgagtgagagaatgagtgaatgaggaataagtgaatgagtgaatgagtgagtgaatgaatgagtgaatgagcgagtgaatgaggagtgaataagtgaatgagtgagtgaatgagtgaatgagtgatgaatgaatgcgtgaggagggagtcagcagggaatgggaccagcccaggcatccagggcacctcatggcccaggcagggcctctgacatgggagggctgcccctggtgatggaggcattctgggatggggggttcagctctgtgcagctcctagactcgccattactggggctgagcttgggctgtgcacactctgagtgtatctgcaggcaagcgggaggtcggcaaccccacggagcgtctgccggatgcttgcagagggtgggctgggccctggaagcttgtcactctcttagtcctctctgaccaccgcacccctccccggagcctccatgttcctgatgcccagtgttctcctcttggagggctccgggagtctgcagattcccttggacacaccggcctcgggctgggccctgcctcagccacaagcagcaccagtagagtgggcggcactgacccggcatcccaggagtgggcagaagggtcggaggagcccaggctgagccgggtggggctggggagcccactgcctagacagggccagccagggcgggggaaagacagggagggctgcggtcggccctggccaggcctgtggcccacaaggaaggcccaggaacatctggagccccccacgcctgatggtgggacaggtgggtgggagctgcgcccagagtggaggcggtgacgtggcaggcaccagctccctggtgactttctgggctcagggtcctgcccgggcctcccacggcttcaggtggccccagtgtccctctgggccgagagggtctcagggacctgtgcaccctgggcgtggtgtggagtagctgaggggccggcgggggattctccatcagcaaggtggacgtaggggcccagcctcatgtgcctgtctgggtggcgcttttcccagccctcctggacttcggccgcgcccattgctccaacctcccccagctccttttcaggtgccaggcccggcggggtggggtctggggaaccgaccttccattctcagcgtgcagccgcgctccctgcagctgccacgaggtggcagcacagtcaggcccggcaccgtcggctcaggcctgggctccaggcaccgcagagccaggggagtcccgggtctcagccccatccctcacggcctgcccatggccctgggaggctgaggacacccctcacggcttacagcacatggcagcctggagggcttgggctgggccggagggccgcggcccctcccgctactggtgcctggccctgtgaggaggcccggccagtcccagagtccctcttgccctcaagccactctgcaggcactgggaggtcagaaggcaaggccggcccagtccctgcaccaggatttttacccaatggcaggcagtgaggcctccgtggctccagcgttggctcacatctgggggttgtttgacaggtctcagggctggggtgcccaggaccccccaggtccagttctccaactgccgcccaccctggcccactgtgtgctcccagacacctgggcagtggggctgcctccgagccgactgctggggtgagcaggtggggcagaggaggctccccagcctcgacccatgtcctctggcggccaggcggaagcacagcccgggaactcccgctctaagacccgtcggctccagcgtctgctgaccacctgacctcacagccgcagggcaccctaaccagcaccagtgtgcctgggtggatcaggtatcctagaaagctgccaattcctctcagggtagggtgggaacggctgataatcccccaccccctggggtgagcttggccccacggcctcctgcccggcgctccctgctggaacacggcagagtggccggaggtaaccggatagcaggtccctgggagggagcagcccctcccggccgcccacctgggtcgccacagcccctggccccggttatgcaagtcgccatccggaaagagccacagagatgggtgtggccccaaacaccttggcggctgccagcctgccctgctccccactcctcctggacgtgagcgggaagaggccagggctggcctgggtggccctgccccaccccccacactcccgtgccaggaggctgcctggagtatggccttggcggagggtcacgtcgaggctggacactcatgattctaggacccctccaggagccaaaacttccccaggctgatggagaaggggtgtcccaccatgtgcccagggagcccatattggggcccatatggggccaggtcccagataaggggacctgggaggctcctggccatggggagcaagatggcagagacgcagggctcaggggtctgtgaccatggagggtgggctgtgctctcagccccccccagctctccccagcatggcagcacccagggctcctgaggagctgggtccccgcagtcgccacatcttggggtgtgcacaggcagcagctccgagctctgggcagcagggtgggtcccatggttggccacatcttggggtgtccccagcagcagctctgagctcccgggcagcaggtgggtccccgcgattggccacgtcttggggtgtgcacaggcagcagctctgagctcctggcagcaggatgggtccccgcgatcggccacgtcttggggtgtccccagcagcagctctggctcccgggcagcagggtaggtccccgtggtcggccacgtcttggggtatccccggcagagctctgagctcctgggcagcaggatgggtccccgcgatcggccacgtcttggggtgtcctggcagcagctctgagctccgggcagcagggtgacttcttggagcaaccagagatccaggcagctgcctggcccaggtgcagagagatggatgctgcggtggcatggatgccagctgagccctgggagcagagagacctgaggatgattttaaggaggctggggccagtgtagggagcagggcagctgcccggggctggccactcaccctgggcacagctcctgcccccaggtgtcctgtattcaggacgggcaccgactgtgtgctcgaatgtccctaggcaggacccggaactgtttgactgagggacagcctcgtgggggacaaaagactgcagaagaggtgaccacctagtagagaacccgactgaaccaacagaggagccatgggtgctgacgggacagccccacaggccttggctagagcggcccaaagtcagcgtggttcttccacaccctggaccaccaccggaaacgaccacgtctctggctgtgtgaagctgcgtagtgaatgtccatgtctccagcagcggctggagggatgcagaggaggactcagagacggaaggggcattgcacacacaggcgtgctcccccaggccgatggcagctggtgagagctttggaggaagttggcaaactcgtagaactacccggactgaaaaaggtcctcaaatatccaggtggattttgaaaggcacgagcaaaagtgcagtgccctgccacccaggagggctccccagcaatcatcgcagggaaagcgccccccccctgggtcacagtggcttccagcagccgtgctgtgtgggccgccccacgcaggccaagggacccactgagggcccggtgaggtgcccgtgtccctggggcctcgccgtgttgcagagcagtgcgcagggctgtcggctcctgagcatctgctggaaggcctgcaaggtttggtcctgagtgctcacagctcagagcccaggggtggagcctggccctcacagtgagcagagcaacgagatcaccgggtggaaggaaccccaaactggagctacagggcaaaataagcagaaaggagaattcaagatattggggctagaactgtgggggtgctgaccagagcctgcgggagctggggtgcgtgtggggttgggggtggcgggacagagagccccgctgggagcagggctgcagagagcccccagccagggtggctggaccaaggtgggccaggaggggtggatacagaggggccaggccaggccgagtgcggcgggctttggaggtcccagtagaggcacctcgaagtcgcctcaaatcctgctgcttctcactcaccctggggctttctcaatgctcataaaacccactggaggtcacacacaggctgctgtatttttacagaatagaataaaaaataaaaccccaagggtgacggtgacaaagtatgtgcatcctgggcgctggagaaagacatttttatgactaggttctgggaggcgtagacacagcggcccggaggacatggagagcagcaagttcaggtagaaagaaggcgcctgcaggcaggactatgtggctgggaggccgcagtgcgtccggcggcccgacacaggcccagcgggaaggacgtgctggcgccgcactctctgctctcacccgcctcgtcgtccggactgactgtttatccgaaggcgacgtgcacccctcaccgcaatctcacccactccctgcctcgcacaaccatccctgcccggcccgcccacttctccaaatggggggtcctcagccctcggagcccacccctggggtcccccagccttggtgccttagctgggacttggggtgagggcttctgtgctggccccaccctcaccaggtgaaggtagacaatgaagacgggccacctgagctgtggggcctgcgagactcagaggccgctggctgggcccctgtcaaggtggaggcagctctgtcacctccgggagctcgccctgctcacgacccaccacgtgccacctagtcccagaccctgcaggggccctgagagcggtgcttaccaaaccagaggcagaggcctgaaccccaaaccatccagacccatcccaggccagcgtcccactgctcctctctggcgggctgagccagaggctcattcccacccgggcagggtt

SEQ ID NO: 5022 - DNA, 80345 bp, Homo sapiens
  misc_feature (23999)..(24042): n is a, c, g, or t
  misc_feature (30681)..(30725): n is a, c, g, or t
  misc_feature (35939)..(35958): n is a, c, g, or t
actattcgagctctactaaaccactctaggacatgccttctttgggtcatcaaaaatcactctcctcgcctaggttttattcttgccaacttagcattcccacggcaattcactaaaacgccttaaaaaatcattagctctcatttattcaacttgaacatcagcatggcctgaagccgggaagaaacagactggcatagtgacgctgccagcaccaagtaaagttttacctcccacgctccaggttcccagcaagacttccagccagggctgccttccactccatttcagcctgcaccctgactctcgctctaccagctgttggcacgccttgtgttaaccgagaatttgtgaaaaagcagaaccttcccactgcgtgttagttttgcttggcaacactcaacaatctcaaatggaaggccccaaggaaaattttttgttgttgttcttctgcccccaggatgattttttctcttcttcctgaacctgtttggatttttttccacttaaaaaatctagcagcccccacctactgatggatacttgtaggtaaatgactctatctgagcaatgatgcgctgactgggccttaaattatgacccattgtggttagttcaaataaaaggaggttccgataaaggaaaactgcactcggaattttctctctcaaaaaggatgatgtctagggatgcaaaattcaggaatataagagagaccttgcaaatgtatcaggctcttctaaaatacaagggattggtataaaatttcctggtgaaatcaaggggaagcacacaggactaaggaaagagaggcaagaaatatattcttctcctttgcagggaaaacactgcattgggaagaagcttgctctttccaaatacattcattaaattgacaaccacagccaccactgccaccacaacaaaaatcaggccaacctagacaaattactaggaataggtctaatgttacttttatgaccatgaggtcctggccctcatcgaacctctgggttacccgtcctatcacttggtaatgaatttcatatatgtatgtgctgtaaagcaaaaaaaaaaaaaaaagtaaactcataaataattcatcacactgtctcctgccactgatcatatattgttcatgtttcaccggccatattaaataaaaatttaaaagtgtttcgtttttcatttaaaaacctagtctataattggaggtgaccacacgaagtgtcttgaaggagcaggcattaaaaaaatcattacttaaattgcacagttaaaaaatattcattagaaatgctaaattaaagaaaaaaatgttagggaatcttagggaaatgtttctcctaaatgttgtcctaaaactgcttcactctaaaaatctgttttgagcgacctgataaaagggaaagagaggtttcagctcaaactcaggaaagaaaggctgtaccagtttcttcagaatggaacattaaacaggccactactgaaacagttcttgtgcctttgtggctaattattacataattgatctaaaaaaatttttttaagtttaggaaaaaaaattagaagcctagtgaaagtaccaaaaacctgtaacttttttgtttaaaaatttatatcatgaatcgaaaatcagaggagatggccgtttggcctggtctccgtcctttccttctctattttgattgagccagtcccttgttaagcctcagaaaacagagcacacttagagctcttaaactgctttagacacaaagaaaaaatttaaaggaaaaaaaaagcaataatcgtgtgacatctcagagatgatagcatatactgttgtttgcttgatgacgataacacaattctttttgaactaagtatctctctagactacaactggtcaaaattatagatattttttgtggccctggatgaattttctatttgccaaaactcaaagattcaaaaccaggttgatgtctagttaaagatgatgctccaactgcttgagatgctagtcatttcaacagacattaagattgaaggagtgtcatagattgcttaggcaattagaaattaaaaccgtttcaaagaaaagaaaaaacaacaacaacaaaaaagttatgccataggaagatgaagcctcatttactaaagtggagaaatgtattttattttattgtccttatggcgttattgccagttctgacacatattacaaatttcacattgtttttctgaatgctgaggtcagcctaccataagcttgtcccgttgtattaccaaatggctaattccctcccaggtattggaaaaaaagtcagaagggcagcatcctaagagaatgggtgcccagtatgacaaggagctgcaagataaaatgaactttctaactaaaaacagaaaagaaactataaaattgattttaaaactgcaggacatttttttaaaataaaggataaattaactatgaatatattgagtggttataaactaatatatcttagcataacagagtagagacagctttaaacttttctatgatactctatagttatattttatgatggtctaataggtatggggtacataatgaagaagaagctgttgtggattcattgtattttattttattttattttttactgctttgagtatgaagagtctcccaaatatactacttataaatcataccaaaagtgcatcagtgaaaaccacagttccattcttaggggaaaaaaaaaatcaagaatcaagttttagaatccaacgatcacattttcctaattacaaacgaagacatcatgtattatttttctgtatccacaagagatgagagaaatgaatttttatcgcatgttaagttttcactgaatcacagtattattaagctttaaatcagagattgtttccttcagctaagtctaacaatactagaaagtaaaagggggggacaaccccccctcatctggggctgcaatatttgctgaaaaaaatctacttcaaaacattaatcaaattttcgcccactgggcaaccatatggtacagcagcatgtgaatctcacaaacttgctgatccctgtaactgggtgcaattaattacgctggctgcatccatctcttggattttcgccttggaaaaaagtatttattgcaacagcttttacaaaacaagggaatgaaaatcacaattgataatgagctgaatggaaatatttccgttagcagatttttttaaatgaataaggattaatacatggatgggaatgaacacacgtcgatctcgccttgtactttttggacccccaaaaaggggcaaaagagtgggcagagacggtgctgtgagttctaacatgcataattcactagcaggtttaggtcgcaagtaataaagccttaaaactggtgaagtaataaagaggctggctttacagatactatcctgggagacagaaagcttgttctttgatgtgaaaacacagatattaaatctcagtgggtgaggaacattacaggcctgacaaagaagagaaagggaagggctcttgaataagcaacctactttgtcctcagctatttaggtgcaaaggttgctgcacatatgggccgttactgttttaagatccctccataaaaccaagcatccgagagtccgtcagaatggtaccctgtccttacctactggctaaaggcacaaacaatgcataattgcaaaatcttcccccagaatgttcagccatcatgcacttgactttgcttaacagtcagacctcgttctggtgctgaccatcctacggggcttcatggagcttgtttcttgatacacatgagggtcgtaatccctccttctaacttaatttttttttttatttttatttttcagagacagggtctcactctgttaccagctggagtacagtggctcactataatgttgaacttctgggctcaagtgatcctcctcctcagcctcccaagtagtcctccaaaggactacaggtgggtgccacccagcccggttattttgttttctctttttttagtagagacagggtctcactgtgttgcccagggtagtctcaactcctggcctcaagtgatcctcccacctcgcctcccaaagttctgggattatagatggagccaccttgcctggcctcaatccttcccttctgagggagtgacagatccaaggctgaagtctataaacaaagcagaagcagatgcactttgccccttttcagaagtgccctctgggttaagtccaccagctagccaagcattaatgacatcatcattacatgcatgcctatttcaaaagatcagttccattttccctaaatagacagcagaggagaccgcttccaacattttgcagttgttaaatatgtatcttgagaaaacgaaactaatactaaacataatggaagaaatagtaagtttgaaagatcaaatatcgtatgactcttgaaacagataaaggaaaaagctgttggaccaagctttgtaagtcaactcttaagccaacccttttctttactgcatctattgcattaaacttctaccaggaaattctgcaaaggacttggttaaagagaatttactattatttattaatgcctgcagagtgtgtgtggctagtatgatgatttctctgctcaagtttgttgatgattttgtagaaatgtccacaggagataaaatctgcaaactcctcaaagatgagactggtccaagaaaagagtaatgatactttataaaacaagaagtaagtgacatttgaaacgatgttcatctcaaacaacacatttcctctgagctccatgtttatgttaacatgtaagtttggaatgctgatgtaatagacaaagataactcttgccacttcaaagtagcaggcatgcctagtgggcaagaggttcagaaagccagcacttaaggtgttgaaggggtaatttttaaaaatttaagaaaatcattccatttgagaatcggagccaccttacaatcaaagaagccactgtttgaagaaaccactatcctgcaaaaagtagacggaagttaccaacaaaaagtacttggctccgaagaagaggaaaatcagatgggaacgggttgtccaaccccttaaaccagtgaccctcaaagtacaccaccacccaccaccacctctcagatgatctctaaacccctcctacacgcatggttgttggcttaaaagtttaaagagctaacaaaatgttttaacgagatacaaatctagagatcattaatcaatatgttcaatgttatttgtgataattcatcatgacgtgatattatgggttactgtacccttcagaggtgagattaatgcaaatgagctgccacaattaacttactgctcccacctcacaggaatggacagatgattataaatgacaactatatgtcaattaaatatccaataaagtgaagcttagagaacaatccatctccttttattgctcttccttgagtagctgaatttagctcaacccactgttgtcactatgtaaccattgtttgggggagggaaagagatttttcttctttttttttttcttttttaatttttcgatgtcttaagaagtgctcaaaaacgtccatgtaaatacgttttctaaaggaggagagccacaggaaaccaggaataatgccacattcatcctatgtgagttaaagaaaactgtatccgttttcaaattgtagcagaaggccagcaaggaaacaacctacccagctgtgtataatatatttactcaattaaaaaagaagacattagcacagcatcctgaaaagccttgagtttcactaaacaaaagttatttgaaatgactccatcgaagtaaataggtcacagagtggaaagcaggtatgaggccgagggcggatgaaaggtttgatgtcagtctgtacacctgcacttggaggtgtggagtggggagcagtcagtaaatactacagtgctggccctcacagcagagaatttctgtgtctgcatcgttccccttgcatggatggagtgatttttgacagcagtctctctggtgaaggtaggcacgttgtatgttgcctcctcaacccagattctcctgccgggctggtgaacccagaagctgtaagaatagctagtatctcacagctaccccttcctgccccacttgagaggctatgtccacgccgcctcttccccagcagacactggctcatcgctgactgccataggtcagccaggccctggtccagtcaggaccaactctgctgtacaattcaccctccagagcttcccgtgggatcaagctaagctgatcttcagctaagccacatccttcctggacattttccctgtcctttttttttttttttttttttgagatggagtgttgctcttgtcactcaggctggagtgcaacggcacgactcggctcactacaacctccacctcccaggttcaagcgattctcctggctcagcctcctagtaactgggactacaggcgaacaccaccactcccggctaattttttgtatttttagtaacatggggtctcacatcatattggccagcctggcctcaatcgcctgacctcgtaatctggcacctaggcctcccaaagtgctgagattacaggcgtgagccactgcgcccggccacatttccctgttctaagccactcttctcatttcctttctgaaagcatcctgacccccatcaatcagtggaacaagaagactaccttgacctgtgcttccaggtaacagaacgcaaggcaggatcaatgagatggaaacaggaatgctcttaatgcagtgcaatttacaaaagaactgttcttgctgaccactagtaagagaccatccaacaggctcctttctgaagccacatcccgaaagatcccctcctgatgtctctagaaacatgcaaaaataaaactgcaacgtcagaaccataaaggatcatagcagattgacggtagaagctatagatttgtgtgtccagaatgtttccccggtgcctccttttgcaaaattggacctcatttttccattagggaacggggcctctcagatctgtggagaagcagagaattatctccagccttgactgcccaggctgcagagaaccgcacatccggggacatgactgattcagggataggtgtctgcctaaaactaggccaatcctggtctccctgtggcttttgggccaagggtagtggggaaaacagcttcttgtcactgggggacaagccaagatgggacagtgctcgtctgccagtggcagccccattcggagagaattttcctttgaagaatataacccataaaagatcatcaaaactaagggaataaataaagaggggactcgatgacatatttaagctctgaataaagctagactctaagcaggggttggcaaactaaaccgctgggccaaacacggctgtgttcttatacagcacacaggctaaaaatgcttcactttttaaatggttgggggcgggggggaaagaataatattttgtgacacatgaaaatgtaatgaaattcaaattccagtatccataaataaagtttctcgcagccatgcctgctcctttcatatcgtttatgcctgtttttgcactatgagggcagagttgagtagttggcaacaaacctacaaggccccaaaatatttattaaatatcccatcacagagaaactttgctgactcttcacaaaacttcgcattttgtcagccagtaatgaccctttcctcttaagctagtttaaattggagctttttgtgtgtaagaggaaactcctgatctactaaaagaaaaagctattcttatccttcccagatatccctgaacctccacccacccagtctgctgggatcctgatatagttggatatttgtccccgctcaaatctcatgttgaaacatgtccgtaatgggaggtatttgatcactggggcggagccctcatggcttggcgctgtcttcaccacagtgagtgagatctctgagatctggtcattttaacccttttcccatttgccccaagaatacttactggtgtgcaggtttaccctgagatcgctttgccatgaaatatctcgcttttattatttttttcacatcatctagcatatcgactttggaaacgaaggatatcattctatttatagccttctgtttttatagtggtatttccatttacaaaatataatagttctccatcactgaaaatgtcaaatccggaaaatgtagcattcctgcatgtgatgttaacatcattctcgaacagttgttggctgaaattcatttgatgaatccgatttttccaaaatacacaattctgatgattcagatgattctatgttagttctgttcagaaataattccaagaactgtttttatattttattatcactttgaaatcggtcacatttgcttcagcttcaaagagcatgtttatgtaaaattaaatgagcgcggcagtgagctgcgctttttttttcctaaacaggaaaagggttaaaagtggggcacctccacccccaccccacgctctgtcacttcccactgtcaccatgtcacctgctgctctctcttgccttctgccatgattgtaagtttcctgaggcctccccagaagcagaagccgctatgctcctgtaccacttacaaaactgtgagccaattaaacctcttttcttataaattacccagctcaagcatttctttacagcagtgcaagaacagcctaatacatatcctacaggtaacgttcaatatccagatcaagtgactggttgtttctcttacctgtttcgcagaagttattgcatctttgttgaatatcacaaactgttaatatgttaatcttaaaacatgtgaaatatatatatatctatcattacaactacaattccaaatatttatatataacgtcagccatgccaatgacatgcaattctaggcccagcaatggacgataaagtaggttaaaagtgggggagaaaaatggttttaaaaaactgtacctgaagaacatatttaatttaaagggaaatcccacaacagtaaattgttcccccagttgggtagagcctgccatgattagctgtaactgcctggaacacctagactcagctgacgaaactccagttgcctggtgagaacagagtgattttgatgactttgcagaggatcagaaagaggggaaacggattcatttgattcatttgtggtttcctgtttccataaggagatagttacaggattaaatttctcctcccttttccctatgcactcacaccgggtcccaggacagcaggaccaatcgtcaggaaaatacatccatactgcatcccctgatcttcatctcaggttgggcaggagggttagcagaagagttatttccctttgcgaagattaagggtatctcacttttattttaacaatgtgaagacaactgttgttccttactattaccatctactacactggattctaatagctctattacattttccatacattctcctggcatgggcataaatgggtgagacagctctggataaatcactgccagcagcagaggcattttctttaggaatgaaggcttccatatagcatttaactaactctctttttggaaacaccccatcacaatgagtctttcaaactgaagaaattgaaattgatttcttagggtaataattaacctcagaaataatgatgaaaagttgcttattaattattttttataatatactttgggaatatttctttttccatgaaagatagagacaaaagtagacacattttacaatcatataaaatgtgatagactcatattttataggagaatgaaactcatttaatttgcaaaatacttaatatgagaggaggtgtccccctacacacacacactcttttcaagactcttaaatagccctttttaaacaacacaatctctctgttctgttctttatttcttcacacataactgccttggagcttttatatattattgctatttcaatcccccatggtttttctacttattcaaaaagaaggtattttcatctgaatagccattgacagcgaactctggtgacatcctcagtcttccttgacaatggaggaggagttgtcaccaagaaacttgttactatcccaagtaacgagctagcatccctagataatacaatagagatggactagtgtttttcaaacaatttaaaacacacacacttattacacagaaaaacacatgtatacacgtacacgcacacacaaacacacacactttaaaacccctctttttctttagtcacctgaagagtcgtaaagcataactgcaaactgataaaggttaaattaaatcatataatagatgttgttgcaaatcgtacatgtctgtcagatcaccgagtagaagtcaaaacatgaaaagaccaggaaatacccacaaaagaagatgtaattgatgagctattcaagatcttttattttttccttcttttgctagtggaaaatttttattctgcactttctggcggagggtggtattttgttttctgtaagatacaaacaaaagacagttgtgtaaattaagttatgagaacaacatagaactgtttcttgaagcattccaaagataagtttttgtaattaattaacaaattcaagctggttaaataaaaccttcttccaacacctcctatttattgcagtttggcaccaacaaatatatatcaaaattatagtatttcccctgacaggaagcccttccttccacacactattatggctctctgcagagtaagccagaattgctgacaacctgaacactgctacaacaatattactatacttggcagagaagtacccttgcggcaagagaaagctgtaattttgactgtcacttcacattacactagatattatttcactgtatacacatcacacactcacaaactcttaatagactacagttttcgcactgcctgcctttccaatataatggcaatataataccagcaaaccgccaatgagatcctggagagaaacaaatgtttggcttatggaaacatcatcagaggatgcattttaagggatatttcattgctttgtcccccaccacaccgttcacaccccatcatcaacttcataagatcatcaccttggttatcaaaaagaattcactttttttaaccccatggtgggccaagtcagcattaacaaattccatgtttaaaatttccatggtgttagcaaaggttgtgctatgactcgtaatattttggacattcttcaatctgatgcctgttatgtaaaatttccagatttcaaaatgtatcctttttcctgcatttactcgctttccttcacacccggggggagtttgttaaactgcagtgaccactggcagagtccaagccaagccaaaccgtgcaaacatgaaacggccccacaaatcatgcaaaccctacacctgtccctgccagagagcagcgcctgtctttgcagagaactaaatgcaacatatgcttcttcttaccaagctcacactgaagcagattgggccaggttccccactgtgccctcccccacccctgcccagctttgatttacaagatgctatgttaatattccctctatttgtcccaggaaggaattctgtgatgtcggtatgagctccaaattgagaactccctggaatccggagcaaggtcagaaggatgaatacacagagggagaaaactgcaacttccctcaaggagagaatgtagaaatggcaatgggcaggaaagaaaggatccttacatcattttatagagagtcgttctcccttacacaaacctggccaaaaatctacagaatgctgaggaaacacggctattcaacagaaaatcggagcttctctctctacttaatctctgccatccccctttttttcctccccttcaaattgctacttcaaacgatttaaataagatttaaacttgttttactgaatcaaggaaagcaacagcaaactctttgccctctgttaagagaatgtatccaaaacttcaccgggtcgctgaccacaccgaatttaacaaggttcgcaaatgaactagagtaagtttcccacagtgcacattaataataagttccttatcccatccatcccaagccatgaatatgtaatgttataaatgagtccttttcacacaacggaatctcagacgtgaataaataaaaactatccatcacagcctgtgaaaaattaatgagagttcggagatgcaaagaaaaatggggacaaggagagaggcccagttcataaaagcctccctaaaactttcagacattaaatatcctagcccccgtcctcaccaaattgccaggtgtgggtggaaagcaacagattttatttttaatgggctaaaatttacagtcttaaagcacaattcatgcaagcaactgagagatcacagctacaaacactgactttctattttctccatgcgatcccaatttcagctgcagagccagagtttatttctttattattcataattcataaccaacctacttccagaaggatttgaggttgctcacagcagtatgagaaaagggagaagagtggggctcgcgcagggctcaaacatcaggagactggaaaactctgctttgtgcattgttccttgacatcgctgtggacacacagtgcctgattaaattgatgtgtcgcttgggttataattattatcattgtcaaaaccacttgctggatgctcactcctgcccagcattacactagtgctatgccctgcataaactctgattctcaccctctatgacccatttgacaaacagggaaactgaggctgggaggagctaactaacctaccccaagtctagagctggtgagagtaagagccaaaggaaggaggttagccagctccaaatcacctgtgctcccacctggggccactcactaccactcatgagttaaggtgtatgaaaacggctttggtacctccttcttgccatcatgaaactgcagcacgctaatactgtcagtctgtctcagaaaccctgccagccagaaggcttaactttgagatgaatgcaaagcagaatgaagcccaggaatttgggggtctgggctaaggctgatgctgggcagcagattagaggcagagcagagcccaaagtccagcctcccctcccagtgcactcctcgacaagaggctgcacttcctcgtcggaagactccaggtcccactttgggaccagacatgctgcaaaaacaaagaaattcacccaaacggtttgccctttactggattttttctgagactgaaagtgttgccttaagggacaaatacaaaaggaagatttaaaaatggaccaatggggacaatctgcttaatctggcccaacctccccctcctcccttctccaccatccattccatgtgggcagaacacgtgactcatgggattatgggagcctgccatgctgttctgttttcaactcactacttttgtctgcgctattctttcttcaggataccgccccaacctctccacctggctaaatcactcatcctttgagatgcagagccaaagagatcctcagcacatacctccagaaagccagttactgcaggggatgcgtacgaccagccaggtaatgtcaatttggaaagcgggccaggtataaattaataggggctggttgtgtgagctgacccggtgggcacaagccccatcatccaactggggcggccaccgtacaggtgagtcaagggctgcgcccgggaaatgtgggagcaaaggtgccagaccttccagtttttaagagaaaccaagaatccaggtttttatgcgaactttaaaaaaaggggatgtgggggtggggcagcaaacacatgcctgcaggctgaattcaccacccccctccacgttttagatctataattacatcttctctttaggatccttaaagcataaaggcaagagccaagtctcagtaactctgcatgggccacagctcggaaaagaaaaaaacctgttatatcgtgggagctcagtcttgctgaactgaactgattcacatcatgacttgggattcatgaaccagaagcacaggaattaataaaaactgaaaacgagccaaagagaagggaaaggctctcttaccactgttgagatgttatgtttaatccctgcaagcagtagagactcagtgtacttccatgaagtgctgctgggcattcatgaggcattaagggagaaagaatttttaaaatctttgtcttctcaaaaggaataccacgatggggccatgtctagagcaaggtgtctaaggtgattctagggccctcgccaagaaacgaaagcagcattgaacatgtccaggaaggatgtgaagcctgaagccaatgcgaagacaaagctagataacccctgtctctaagacatagggacttagaactcttaccctgtgagcaacattgaacattggatgtgttcaccagaatggaaggagacacactcctgccgaatcatgaagggcaaactgacccagaaaagggacaggtcaaggaaggtattacctctgcaagttctaggtgtcctgcttaactcattcaggaatttcgggccagagggatatccaacagaattctaacctgaagagtttagaaaccagtaggagaatcaggatgaattcagaaattacataatatgcattttcaagtgataaatcccatcaaaaacagaaaaagtgcttgaagaactgaaggaacagtgatcattcttgtcagatggaatcttaaaatccagtgggtttcaaaggagagcaggagctggacatgaagggattggaggatggggactggaaatggggagttcattgaatcagaaggaagagcaagaaaggaacaaaaagcaagcagtgtttggggagaccaggattgattccagtttggccaaaatatagggtatactgggagaatctattgaggttttgggaggtatttgtttgtagtttgaaaacacctaagcaattttgaagagaagcagactctttaagcagatgctgggttctccagtccaaatatgccaatataattgtgtctggtcaatgtctatctgtccatccctcctgagtgccagatctaaatccaggtgccaatggatgacttccacttggtgccccacaggcgtcatgaattcagtatgactgaaaaggactcctcctatcttcagcatggttccactacacaatacactgtccaagccagaagtcccaaactagccttctgtcctccttctccattcaccacgcctgtcatccccttcagagctgttggccaaatcttgttgatttaccaagtatctatcaaaatgtttcctcttcctccctgtactcactgcaatcacttttctcaagggctcatcatttcgtgcctgggtgactagagttgtttcccagcaggtctccccccctcctttctcacatggctgccagaacggtcttctgaaaggcaaatctgaccattcgaaactctgctctaaattcctcctatggatccccatggcttggatttaataaatgtttattagtgaatgagttctctgcatacatgttgttctctgcctggtaccgtggaggtcaggctccacagaagcatacttatggtcagagttagtcaataaaaaaagtgatctattctgagttcataccaccccaaaacactgatcagcttggggaaacttagaaagttcaaccacctggggaaaagtttggaaaactaggctagggccaattcagggtacaggtggaggctaggaagtttgcataggatatcattaaaggtcttctaaggatgaaggcaattggagctacactataggaagcacagcaggcggagaacagacttgagaaggatttgggaggtgaagaaacagctaaaagctctatctctgacaaagatataatgcccagaattagaagagtggaaatgaaggaatgataatgaaagagattatcaagaagaaacaaacaaacaaataaacaaacaaaaatccctgtatcagtaaccatctattattatgtcccagattttggaaatgagaccctaatgacaagcaccctaaaccttcaacatagctgctgttaaggatgttgtcttgtgggggtgaaaggcagacaaaatgatactaccaccctactccttaccgatgagtcctttctgattttaagcaaatggatacagtgtggtgaattaaaaacagcattatcctgattttattactagtatcattactatagcattattgctactgctgttataggtaaaaatgggaacgttgtgaacatttcccattcctatccaaggtgcttggtactttacatgatatctcacttaatcatcagaaagtttggattattctataggtaatgagggagatgctattattacctgctgtggtggaataaagatggtgcaaattctttgtcacttctaccagaagaaagtgaggtgtatgtctgctccccttgaactgagtgggttttgtaactgcttagtccacagcagtcatgctgtgccaacccctaagccggccataagaaactggcagcttcctgttactttcttttggaatcctctgggagccctgaccaccatgtaagaaatctgatggccctatatctgccatgcaggaaaggccatgtgtaggctctgggcaagagtccctcagctgagccaagcatcccagtcatcctcgtgaaagtgccaacccatgggtgaccatcctggaccagctgaagtgccagtccaattcatcctccagcatacaccactgactgaccccagtcaacaccacaaggggcagaagagtcactccactgagcccaacttagagaaatcacaagataaaacaaaatggttgttgttttaagcctctaagttttgggtaatgtattatgcggctatacataaattggaacatccacgttttacagatgagctactgttactccaaaagtttggctgacttatctgtagtctcctggctgatgaggtgtgcagctggattagaacctccatctgcctgacctggctgcacacaatgcttgttaagttatcccgaaaacgtaaggccatacaggtgtggcagactaattaaattcaccatgctctttgggctggtgactgctaccaaaatgtcctaccctacctcacatattcccttgttaggtagagaaggtggacgatgctacaactgcttctccgccaggcctcccaacgccctcgctgggcagagtccatgtgactgttttcactgctagaaaaattaacttgcataatgaccaggaagtaaagataactcaaggatgagagaaaacctcccacctcagaggctccacctcactggggtgaacaacactgaccttctatcatcctataaggaaaacaagaagaagagatgtttacttgaattacacataggctccctgcctacatccacatcttgaaaattctgagctgtgaagctcttgtggtggctcctgggaacttgagattcccagtgatattccaatgctgaaacagcccagcaagggatgcaggtaagcacgcttgtaggatgtaacaatgtgaaacctcagcacattgtggttagtttcaaagcacgaggtgacggaagcaagagcgagtttacatgggcttgtgatttccttgacaagatacacgcactcattccttcaacctaagcaaaatttccaggactacaacagattgaaactcaggtggacgaaaaaaaccatctgtgaatgggataacatacgaaatcatcaaggtaattgttttaaaaacgtgactcaagatggcacagaacagcgtccacagatgtattctggttacttaaaaacacaatttaaagtaattagcttaatgttgatgtaattctagagatgataaataaacctaaaaatcttaatttgatattgaatcgccccaaattaaacaacatatttcaaaccactaaatattgattcatttgtaagatgaggcctttcaatgcaactatttgactgaacgcaaacaggaaagggttgacacattttctctgtgaagggccagatagttaagtccttcatcttcgggccacgtatcgtctctggcacacagccttctttggattttttgttctttttgttttttttaacgggtcataaataaaaggctactggctggagttagcctttgggcataattggttcattcctaccttttcataatctcagttattgatcaggtgatttttcaactgtgaagggtctacacgttcaacctcttccttgtaagttaatgagttagctaccaagtttgaggaagctagcagaaaacaggagacccaggatcagatacagaggacttcgttactctggcagagcaaacagcatgagctttatttctgcactgattcccattgccctggcccctatcccacagggaggatgtggaacagcccggtagatgccgtgctcatagtacgtttcagtctggctgaggagccccaagcttacaaaccccaacctttatcaagcaaatctgccaaaccgtgtcctggaaggaggcactgtctttattatactggaaagaaagccatcctgtcctctgccctgagggagacactatctgtaccttgcaagtttctttgctagacaacgttccttggaagatggcctgaaaccaaagctgccagcacttctgttcccaagacatgtgaaaacacaagaacccgaggatcactgtgtccaaccaatgacagctaggagaaaatgcaaaaactagcattccttaatcacaggggtctttttctatgaaccaatcaagcagatttatgtatttttttcatgccgtaaaaaaaatttgatgattttgaggcttaacatcaaataccagtgagatcacaattagatatgacatcatacacatcatttctgctgaaaaagtacctttagttaaaaacagaaccaatttgtaaatgtgaattaaatgcatactccacaaaaaaatacctggtgaaagtaaaaaaaaaaaaaaaaaaaaaaaacttccttatgtatagatatgtttcctgacagatgtaatgaaaactaatacggtgacatttttcaaattagccactggaaaactgtgtgtgtgtgtttcaaacagcccgagcaattttcagttatgtcggcctcggaaagtatttatgaaaaggatataaataattaattctactggccagaagctgcaactcctttctgcttcgacaatatacatgaaatgctgtttaaattagaggagcaaattgattcaaaaggcttccattagtgagctgcaaacaggtttgaagttggctaataaattttagataaagatagagcttttgatgaggatgcaatgccggactgctgatctccgagtcaccagtttgttaaatcggtggctgaagtcttatttcgctccctgtgtcataactcactgtgttaaacaatatgtcacagggcagcacgagacagtcaaaccagaatggctgctgcaggagccatcagcatgactgtgtggcagctgctccagagcagggactaacatgggaaccaggctagcttttgcgtccctttctgagtctccagctatccgggtttgcagaacattaatcaaggttaattaggcccacctgtgacataaaaattctacctatgctatgtcttgcagcataaagtcacgtctgacatatctattaagaaagatcttaatcaaaatcaagaaactacgcatgaagctcttaattccacttggatatacatacttagctggcttcaagctgctcctctgggttgtggaatattacacagctctgtaaaggaatatttaaagctgtacatactagcctgaaagggcacacactgtacactacctggggatggtgagtatgtgtccacttatttcagaaaatgagaacaaaatcttatatatgtgtacatctaattaacatgaaggaggatgtacaagaagtacaaaatactaatcatggttgcctcagaggatagaattagatgaaggaatagaaagggtttttttaatgcctcctttagacagctctatattttaaaaaattattcaaataatgtataataatgttcttttataattaaaaaaatctaaaccaagaaataaacaacatgaaggcttatgtgacttgcagaaaattataaaatggggagtcatttatttgcttagcttatttctacctggccagtttggggaagcctgtggagaactatcaatctgtctttctgtccatccactcttccacgtatttaaccaagaaaccagacctagaaatggtgggtgaagagtaaacagctttagaatccaccaggcctggagagaaattctgctctacccacttgcaacctatgcagctttggaccatgctctcgatgtcttccaagaataaataattgtaagagctacagcaaatgcaggtagtgactctacaatttcatccacaaaggtagctcttttcctgtgcacaccaggatctcagtatggctaccctgagcagaataatctaacttggccaagatggcaacccaggatgataaaagcaaaacacattgcagagatctgattttaaggaattcaaatttacactttctcaaatttgtactacttaccaatggggaaaaataaatgctactttttttttaaggaatactatattttcccttttatttgtagccacttttcaatggagcctttgtgaagtacttccagccttggtcccaccatgggaaaggtggaattcatgaggaaaatcgtggagcaagccagacacggcggctcacgcctgtaatcctagcactttggatgacaaggcaggcagatcgcttgagtcaaggggttcgagatgagcctgggcaacatgcaaaaccctgtctctactaaaagtacaaaaacttagccaggcgtgggggcacgcacctaagtcccagctactcaggaggctgaggtgggaggatcacttgagcctggaaagtcaaggcgcagtgacttgagattgcaccatggcactcctgggaggctgaagaaggagaatcacttgacccggcaggcagagatgagcctgggcaatgagagtgagaccctgcctcacaatcaatcatcaatcaatcaatcaatcaggtggaacagatactatccctcactacaagtggacaagtgatctgaagcagtgtagggagcaggatgaggacctcacaggcaggtctcttaaaagacatgtcagatgtcctgcagctcatgtctcaggcttggtttccatgcctggatttcgctgccaggactgagccttcctcaggggctcattcccctcgagtcctgggctgaccccagcaagaggaaggacagatacaatgcattccaatcagatggccttcctttaagaacactcatgaaactactgacactttacactgactttcacattttaatagactacaaaataaaatatccaaatgtgcaaatgcagaaaatgaagcgaaaagtcagagtgattcatttttatttcttaattaaaaacaagaaaacatgcaattaatatccgtgtgaccacattaagcactccacacataaagaagcagaaagaacaactaaaaagtatttctcccctttcttagatacaaaaattacgtggtgtgggtacatgtgtgtatgtgtctatgtgtattagttcattttcacactgttgaaaagacatacccaagacatggaagaaaaagagatttaattggacttacagttccacatggctaggaggcctcagaatcatggcaggaggcaaaggcacttcttacatgctggtggcaagagaaatgaggaagaagcaaaagcaaaaccctctgataaacccatcagatcttgtgagacttttcactatcatgagaatagcatgggaaagactggggcccatgattcagttacctcacctgggtccctcccacaacacatgggaattctgggagatgcaattcaagttgagatttggatgggacacagccaaaccatatcactatgagagagagggggagagagggagacagagagaggagagagagagaatagaagaatagaacttgcatttatcaagcacttattacataggagggatgttggaagcgatgagtttagctaagttaacttggttcattccatacaacccaaggtgtggatactcattatttcttccatttgatgaggaatctgaggttgagaaaaataaaaaactcacctacatccctacaggtagtcagcacagagccaagactagactcaagcaggctagtccagagagtcttatggtcaccctatgctatcctgccttcagagggaagggacaaataaaagaacaaaggcagacgtggagatgatagtaggggttgccaagctttctggaaaggagcgagagtattttaggctttatgggccatacagtctccatcccaactactcaactttgctgcatagtgcaaaagtagccacagatagcttataaatgaaggtgtgtagggctgtgttccataaaactacttcagatctctctggaacttcaataaaagtttttaaaatttagttatgaaactgaaatttgaatttcatacaatttttacatgtaataaaacattattctattggtttttcccccaaacaattacaaatgtaaaaaccattcttagctctcgggctgtacaaaaacatacaggccacatctgaccttcaaaccacagtgtgtagacccttcatatcagagacagtttatgcaggggaaattgtttcacctttagtgtgagacaggtctggtgttcagcccatgctcgcccctgtgaaagagctctgcaaccctgggcaagttcttcaacagctctacacctcaatcccacatctgtaaaatagggattaacacccacttcatcaatgtgttttgaggattaaataaactggatgtatattaggccaagcattgtactggatacaggatagacaatttattaagagtctatttacttgacaaataacttactgagtcctgttctgtgctagaaactattttagatgaagacacagctgtgaaaaaaaaaagctgatacaactttgtgccctcatggagctgaaaaaaaagatattcgtgttttttgttgtttttttttttttgacatggagtttcgctcttttgcccaggctggagtgcaacggcacaatctcagctgactgcaacctccgcctcccagatcaagcaattctcctgcctcagcctcccaagtagctgggattacaggcatgcaccaccagcccggctaattttgtatttttagtagagacggggtttctccatgttggtcaggctggttcgaactcctgacctcatgatccacctgcctcagcctcccaaagtgctgggattacagggtgtgccaccacgcctgcccgttccaagatatttctaaatatgaaagcaacccaactttcatcatgattcttagtccatccaggctgctataacaacatacattcaacagaaattaattcttggctgggtgaggtggcttatgcctgtaattccagcattttgggaggccaaggtggcctcagggtcaggagttcaagaccagcctggcctacatgatgaaaccccgtttctaccaaaatacaaaaattagctaggcatggtgccatgcacctgtaatcccagcaacttgggaggtgaagaaggagaatcacttgaacccggcaggcagaggttggagtgagctgagatcgtgcactgcactccaacctggacgacggagtgagatttctgtctgaaaaaaaaaaaaaaaagaagaaagaaagaaagggaagggaagggaggggaggggaggaaaggnnnnnnnnnnnnnnnnnnnnnnnnnnnnnnnnnnnnnnnnnnnngaggggaggggaaaaagaaaaagaaaggaaggagaaaaagaaaaagaaaggaaagaaacaaagatactgactgatttcttacagttctaaggctgggaagtccaagatcatggcaccagcagatctggcgtctaatgagggctccatcctacttcctgtatgtgctttcttgctgtgtcctcacatggcagaaggcagcaaacaagtcccatgcgcccgttttgtgaatgtaggggttatcaacaaacattgcagccataccacattatagaccctgcccgttgaagaatgagtcaagaaattgggtgggtgttctgtcatcgataactcttgcttatcacccctctgcagtgctgcaagtaggaatctcatatacgtgatggagtgatttgtgctttcagctgagagtagcactgtatccattccaaagtttcagttagcctagtccctgatgatctgcaggaatttctccttctctcttaaaaaagaaggaacatgatatccacttgcaagattaggatattctgtttaaaaagaggggataatttaagcagggctggcgtgggggcggggagacaatggaaaaggctgacatctcctgagcatggctcaagaaggcaaattcttccgcatgtataagaataaaacctcttaactcatctcccaacacactgatgtgtggcccaaagtaggctttcaggacagtcaccaggagaaatgttatcttgtgggctataatcaccttctcccaagtgggtccctggggccctctgtggtgatgagcaaattcatgccaatgtcacttcgtaatgaccaagactcaagaagtgatcaccgttacaatattcagatacactagggcaggtggccagaaacaaaccatccagagataaatgaacattttgcgctccacagaaaaaaaaaaaaaaaaaaaaaaaaaaaagatttcacagccaaacacatatttctttgttcattaagggaaaagtcgtgagatggcaagcaggctgtatttttaaaggatgaaatacagaaggctgcttccacactggccagcctgagaagcacactggtgaatccatcccaaggcaggacttctagagcctgagagttggcttcattggaggcaggtgtactggggaaaactgatacctttctacttactccaggtaagtggcagataaatctctgggaagttctggctcaggcatcttctcatcagtaattacaaacctaaaaattacgatctacatttgagtggaacaaaatgactggtggcacttctttcttttctttctctctctctctctctgttgacagccccatcaaaagtctctgcaaagctatgataacctcacggtaagtaacaaatcaactgcagccagcagggttgattaagaggcgtttcatcactgcatggtgttaatgagcatttgctgttcttactgtcctgcacttatatccccttctccccattcacctttgggcaacccctcttctctgtgacttcaggggagccggaccccacatcctgaattaaggggtgagcacatggccctggatgaccaatcggagatggcctcatgactcaggtctgtccaatatgcatgaagccctgggcacgattggaactttgaggaaagagaatcactgttgtcctggtcttgctgagaggacacagttatttatttctttgagaggaagtctcgctctgaagtgcagaggtgcaatcttggctcacgcaacctccatctcctgggttcaagtgattctcctgcctcagcctctcgagtagctgagttacaggcacgcaccatgtttcccccagcttctggcttgctacactatggaatggaagaggatgcccaagaagaccaatgtaaggaaagcagagccaagggatggagacagagcatgcctgaaaaaataaggcaagcccatgagagttgagcagggctaaaaactgttttgtctctcttgttgtttgatagtgtttcaaagccctcagggaatgctgcaaatagcttctcaggctagagaatttcagctcctacttttatgatcaacagagtaagggcatctaagaatgacttttctcaggctgtcacctccccacagcccagatgggcctatatttaaagatccgagtcttagagtccaggggctatctgtcatcacagaccatctgtgggaccttaggtagggcaggtctgaagtctaaatatcccctcctcctgagttcctgtcctgtcccctttgcctgaccttctccactgttctcattagattatacttcatggaaaggggcatatatgccttatatgctggatgtaagctggggacaggggcctgtcatctctggtgtccacaggaagtcaactgaatggctgatctgcccccattatcatctctgaaacctcagcataaggactagggtttgccatatagcggttctgaataaaatttactgaataaataaattaataaagagattgctccaaacagactaaggtcccttgagagcaaatgtagacttctgtaaatctgatcttctaacaggaagatcaaatagcagaatactttgtatctaccagagattctctgtatctaacagaatgctctgtattaacagagatacactgtatctaacagagaccgaaatatatttgttgaatgaagacagatccccattagcagtaaaaagtaattttaaatccacttacaaccaactggtactatttgtattcaccctggataggaggatgtatatttccctctttccttctttttttttttttttttttttttttttgacagagtttcattcactctttttgcccaggctggagcagagcgcaatggatgctctcaactcactgcaacctccgcttcccaggttcaagcgattctttcttgctttctaaagccctactcagatataatgaggccttggcctgtactaggtcttccaatttgcattttgatctaaaatttaacttacacagtcaatttcttaatgcaagttatcagaattggtgggaaaaatgtgaattacaactgtgattcgagaacccaccacattataactatatatatattatatatatatatatatatatatatatatatacatagatagatagatagacagacacaccacacacatggcaaatgggcccacatacaacatgttttagaaattgtgatattgcaagtgagcctcaagctgagatctgagattgttcttccatagtctccctgattcccaaacacgtgttgcaatcagactttttttcctaaggttaaaaggacaaatgcttgcaggtatatatgcaaaatacatacacagtcaatcacagatgaaatacaaaactaaaaaaaaatctgcagaaggaaatggaatttgagtggctttctttttagtcttttctttttatacagctatgatacctttacaaaatatttatttatttatttatttatttatttatttatttttagagacagggtctgctctgtcgcctaggctagaatgcagtggtgcaatcatagcttaccatacattaaaagatcctcttacctaattttatatgtatgtatgtatgtatgtatgtatgtatgtatgtatgatctatctatctaccttaccatacattaaaatcttacatttctacacgtgcaggactagatgaacacacataaagcatgataccaatctgcttttttggccaccatataaacattctagctaaaatgtcaagttgtttcattttacttaaaaaatgtgaatgtgaaatgatttaaacttcaaaaaaaaacttcgaatatcaataatttcacttaaagcttcacatcatatttgattaaaccaaatatttatgaatcaataaaaatttcatactttcattattacttgtaatttattttaaattttaatcaataacttttttttttttttttttttgagatggagtcttactctgttcccaagctggagtgcagtggtgtgatctcggctcactgcaacctccacctcccgggtcgagtgattctcctgcctcagcctccccaatagctgggattacaggcacgccaccacaccagctaatttttgtatgtttgctacagacggggtttcaccatgttgcccaggctaggttaaactcctgacctcaagtgatccacctgcctcagcctcccaaagggcagagataactaattttttttttagatggagtatagctttgtcacccaggctggagtgcagtggtgcaatctggctcactgcaacctccacctcccaggttcaagtgattctcctgcctcagcctcccaagaggtgggattacaggcacctgccaccatgcccagctaatttcttttgtatttttagtgggacagggttttaccatgttggccaggctggtctcaaactcctggcctcaagtgatctgccgccttggcctcccaaagtgctgggattacaggcctgagcctgtaatgtaaatgagcctacatttttgtgaatttatctggcttcgatctttcaggctgctgacctttggatggggtcttgtgggaacttgtttgttagtgatgttgttgttttctgtttgtttctcttttaacaataggcccctcttcccagtaacactgctgtagtttgctgggggtctactccagaccctgttacctgggtccctcccacaccaggaggtgtcacctgtggaggctgcagcacagcaaggatgctgcccgctccttcctctgggagtctctgtcctcaagaggcatcgagctgattccagcgaaacgctcctgtgtaagttctctggcaacccctgctgggaggtctcacccagtcagaagcacgggatctaggattcatttaacgaagcacttagtttacatttctgtaaactgcatagattttatcctatgcagtttagatcatcataaaataactcaattgttaaatattttaagtttttaaaagtctataaataatataagcataaacatcactgtacataaatttgtggataatctttaaatattcctttacaatatttttctagatatgaaattcctaggtaaaaaaaaatttataaaacttttgatagagatctccaaattatatctcagaactatgaaaatcaattgtcttcccatccacagtatattagaatgcccacttctatacttctcaaccttgtgtattatagtttaaacctaagttaattttacatttataaaaatggggtcgaacatggtggctcatcctgtaatcccagcactttgggaagccaaggtgggtggatcacttgagcccaggagttcaaaccagcctggccaacatggtgaaactccatctctacaaaaattagctgggcatagtgcgtgtgcctgtagtcccagctagtcggcagactgaggcaggagaattgcttgaacccggaggcagaggttgcattcagccgagattgtgccactgcactccaacctgggtgacagagcagactctgtctcaaaaataaatataaataaaaataaaatggaatacagtctctcttctaattgtgtcttctctgctaataactttaaacatttttcaaatatcccttggtcttttgtacactttttagagttttgccaattgtcccattatttgtttgttttatttgagcttggtgattgaaagagctgtttacttattaagcagatgaactatatgaacagacagttttttaaaatctatttctacctcaaacacatacttacagaactaattcaaaatggtgcttcttttattacgtggtgctaaattactttatgagttcttaaagattcttatttttggcacgtctgaggaaggaatgagaagttctctgtttccatatgcgagcactagtaacactgtttgcaggccaacacatgtttaaagcaggcagggaagtgaactctgtaaagtggagatttgtggagtgtgtaatgaggcaagtcgttatgttctaactggtcttaactgttccataaatgtttcttttacctgtaaactttaaggtcaagataatatgaggagtacttaaagtaaagaaaagccatgtggccttggctagggaatatgcccttttttttttttttttttttttttggagggaggaattggaatactctttaactgtcgaacgaacacataaaagtacattttcttctctatcattttgccaaactcagaataaaaacaactgggctgcatcattcaccttctaggctgttcctagaattccatggaactgtcaaggcctccaaaagggtttgttttgttttttaaagcagagcctggcagacacaccataaacttagcacagattacccctcgtagcatccgagtgggaatctgttttccaaaggaaaagatcatcgctgaaggcattttagttttcacaccaatgcaatatttaataccaaaaaagaacatgttggcattaaatcttccagtgaaactacattcagtgtaatagcctatttttaaatccctttttagtcccaccaaacggagagcaaacaatatacggtgaatttgctggtacgttaaataaacagtggaatttttttgttattaatgctatgatatgnnnnnnnnnnnnnnnnnnnnnnnnnnnnnnnnnnnnnnnnnnnnntgatttttaaatctccttcaaacttcattaggaaatgtgcaattaatggagccatgtctccgaaataaaatattttaattatagggagaatattttaataaatgagcagctcagaagtcataattgtcacacattaacagattttcctacatcatacttacatacagtatgagctgcatttaaatatagtttttttctgggaaacaaagtttgtgagattttatatatatagtctctgatgttttttagggaaataaaaaaatattggaaacatactcagttcctgtttctagaaagaaaagaaaatccatgcaagagagtggctatttgtcccacgtcacataaatgagatagtaccagaatctaagcttagaaggctaagagttttgaaagttatcaaatcacttttccattcaaagcagcagagatgagtgataatcgtttcaaatccttccaaaagaataaagaatctgggatctaatttttttttttttaagcctcccaatgcagaaggaatggagatggaaaaaaccgctgcggtagactcagattccattccttggttttaattgcgtggttgcagtggggaatgaggagagtaaacgcagtgcctcccacggagctccctgcaggttctccttgtaggagtgagattttgctggtatttatattgtttgagacatacccaaagagtcttgtgtcactcaatccccagctccatcctggctcggaggagcctgcaccgcctcacgggagcctgtaactgtcaaatggcattcccgaatccatcaatactgtttgctgccaaataaataccctgctgctctacaggttgcaaattttcaatcattgtgcagatctgcacaaacttggaaagaaaactcatgcaatctcatggcttatttccccttcctacataagagaaacatacatgcctaaaccttcactttccaaatgttactagaagattagaaaaacaacagatgacaggcaatgtgtcagcctagaagaatcacaaaatccttctttaaacaatctagtagccagatgaagaccccacgccacgagcctgtatgggttaagaagttcatggggcgaccccattccttctgattgctgcgaaatgtaaaagacaggcctcaagtccaaagcctaatgtgccattaagagtagactgccttggcctcacctgaacaaatgcatctagacctgtctgactctttgactcacagtgcaggagattagggattcccgtatggttgttcagtctgtacactgaacaactcagttggtcaacatttacatagactacaaatgatagagacttctacaggtatgcaatcacagatgacagcttgtgtgattctaaagggggcgtctgaggcaatctactaccattcaccaatgttctgctctactctctgttcatgttctgtacatcaaccattcattcagtcattcaacaagtattcactaaatgcaaatgaaagtcagtctcatccaatccttcaaccaccttatttggcagacactattcttcccattagtccatttagcaaaggacagtttgctaatgaccctctcctggcctcagttaattgaggccagagagggtcattacattgcctaggagggtcacaaagctctgtcctccaagtctgagtccgtacatttctctcctggactgagctacccagtttattggagcaaaaatttcctttctcacaatgaatttaagagtcaagttctcaagagaagctggaaggtagggtcagagagattacgtgagaagtgaagcggtagaggccagtaggtttagaaaccagtgctgtgggctgacaggggtgacaatttccagctttggttctcctcatttaggagagacatgaagtctcatggtgtgtagacaggccacacaagactggaagtctgaagtgtgctcacttcatggagtaaatgtgagccttgaatgagttacttttttttttttttttttttttttgagatggagtcttgctcttcgcccaggatggagtacaatggtgcagtctaggctcactgcaacctctgcctcccgggtcgagtgattctcctgcctcagcctcctgagcagctgggactacaggcacatgccaccagcccgactaatttatgtatttttaatagagatggggtttcaccatgttggccaggctggctcaaaccccttaccttgtgatccacctacctcagcctctcaaagtgctgagattatgaattacaggcgcgagccactgtgcctggtcgtgatttactcctttctttgaactttaagtcttcatcaataaaatgagaataataagacctcataaagctactgggaggagtacatggattataagaactagaaaaatgtctggctattgtggatgttcaataaatgatgggtattatattattgactgttcttgggatgtgttctacttgggtgtgtctctggcatctcaagtgtagtattttcctaagtggggtgtgtgtgtgaaggaagaagatgcccttcttttgtgcctcgcttccccaaaagacatcaggagagtaaacatgccccctatagtgccaagagagaaaaattaaattcttttggataaattagcttttgcagctacctctctctttgctatgacttctgttctcctctgcttaagcaacaaagagagaagtaaccgcaaacgctaatttatccagcggatttacatttctctttctcggcaatatagtttcttagtgtcttccaagtttttaaatccttaggtttattcattatgttcctttttcctgcttctaaaaggtagctgttcttgcccactttttggaagtaagaaaacctaggagctgttctgtaagctcataaacatagtgtgccagaactgactagaaggacagcagggggacgggggatctgaatgtgccaagacagttataccctatgggttatggcaaacattaaatggtctagaaaatcagaggccttggaaaagacttgtaaaataacaatgtgagaacttagcataaaggccaggaacatgaaaggggaagccatgggggcacatgttggaaactgtgctggaaacacatcctgaactgctcttgcaaagtgaggcccttaagcagttcctgcaatcctcctcccagccctccataccaggcagaccaagatgtgccccagcctctgggcagacagtgggttttcaacaaccctgactggggctgaggtatgagagtgcatatcagagccccaagagggctcttagaaagggaagttggccagatgtggtggttacacctgtaatccgagcactttgggaagatgaggcaggcagatcgcttgaacttgcgagtcgagaccagcctgggcaacagagtgaaaccccatctctaccaaaaaatataaaaattaccaggcatggtggcagtggcatgcacccgggtgctcaggaggctgtggtcccagctactgggaggctgaggtgggaggatcacttgagcctgggaggtagaggttgcagtgagctgagttgctccattgcatactagcctgggccacagagtgagggccctgtgtcaaacaaaaaaaaaaaaaaaaaccaagaaagaaaagaaaaagaaaagtgatggaacagaggtggtgaaccttaagcaaaaagataacatggattttctggggtggggtggggtggggattaatgatcaaggaagaattcagctgggtgtggtggctcacacctgtaatcccaacattttgggaggccgagtgggaggattgcttgagcccaggagttcgagactagccctggcaacataatgagacctccctccaaccctgccaccaatctctacaaatagtttcaaaaaaaatttagccgagcttgtggtgaatacctgtagtcccacctaccaggcaggaggatcgcttgagcctgggaggttagactgcagtgagccatgatcacgccactgcactctagcctgagtgacagaacaactcatgtctcagaaaaaaaaaagaagaattcttcacgaaagacattaaaaaagaccatcacacaagacctctcaaaagttatgctagctaagccactacaccagattttctgagtaagcagcttgcgatgagcttcccggttgcactcaatttgtaaggcaaaatgaaatgcctgttgagtttaccaggggaatgcgaggctggaggtgggaagtgtatgccgaaagcatgtacgtaagctaccaccttacatttttctttcccaagtcaccaggacatagctcctacaattaatctcttggttttatttagtaaattccattttagttgaaagtcatgttgtttatgctgctctaagatctttaaaactaaattgaaggtttatgttagtaaagttaaatatcttatttctaatatctaaatatatttacgatatctttggaacacccatttgaatcaaccattaaaccaatactgttgaacaggtttgtgaaatcatggcattcatgggtcatgagaagacggtcaaagcacaaagtgtgacacttctgcagatactggaacacagtgatgacttccatcatccagttctgcccttactaacccagtgatcttgagcagggtacctaactcctttgcacctcagtttcagcttaaagcgaacatcataataatgtctattcacagggtttctgtaaaggctgaaagtcgaacacatgcaaaacactttgtgcatggactggtaaaataagagttaatatgtattagatatgttataattattatcattactattattaataaattactggcttcagacatgctaagtgtatatgatggaaagagtacttataactttagaagcaggaccttaagtaaattacttaatcatctgaaccccaattccctctcttcagtgatatagggagaataccaaaaatctttcaaaattaaaagacacaaggaagtagatgccaaattcatctttactttcttgcaaaacagagcggaaaatttgaacaattgttccgatctaaacagagggtatggtcccacatttataaaggcctacgtaaatagatgatattactgccactgtttgcgtttctatcagcccctatgctgataatcaataatgaatgttgtttaaacaaatggtgtaattttgcaatcctgtgttgttccaaaccgannnnnnnnnnnnnnnnnnnnctgtgttgttctaaaccgacctttactccttatgccatttgtaatgcatgcataattcaatgctgaagccgagggagaaataaggatgttgtctaagtggccctttttgggttgttttttgatgatttgctataatcctataaataatacaagcttgtcactgtaaatatgtattgtgttatctagaggtatattcagtggctaaaacataaaagctcgtctacgtctcctggcaatctcaaggcataattaatcgctggtaagatgtttctagaacgtgagagcccttaagtagaaggaaaaataaaggccattgtcaacacaaatctaaaagaaatgcctaacgggcatagtcatttgccatctgggaaaagtgtttgctagtgacttgtttggaaggcaagaaggatgattcaaaagggatttttgttcaggtggtgaagaatgtgtgtgtctgtatgtatatacatacccacgtagtttttaataaattataaatcaagagtttaccaagctaacttgtcaattttaactcatttctgttatttgtttacacacacctcatctgacaaatatatacaaaacaatgtatgtgtatgcacatatacatacatatgatttttttaaataaagcataaatcaggaggtgctcagagctagcttctgtccattctaacccattgctatttgttcacttgcacacactcactgtgcaataaaccctttcaatgtgggagacagtgcaagatgcccctctttccccaaagggcacctctgtgtgctccctcagatcatagctatgacatgtcaatgaaacggtgcttgctctcatcccagagatcaaaatgagggcttaactgcaatttactttacaagtcccatgacacttgccagatctgaagacttcattctaatctccctgttgaaaaaataatcaaatactccaacaaagatgtattgacaactcttaattaacatgctaatggagggaagagatagcatggataaatgaaatccacacataacccaaaacctccttccccattaatttccaacttcttgactaaaccttactgagataagtgggtggggagagggagaggctgactaatcctttaacgatagaattacttgatgtctacatctgtactatccaatcagctgttggacaaggtaacaagcaaggaagtggccaaggacaccatgtgttccaaagcatcggggttcagcggtaatgtttttgaatcttctcgggtgtaagtaaatatattcagacagcttttagaatgaagttagctagaagagttttgcagcaatagaagctgatttgtgtagaccttcaggtttcttatctatttattggtgctgctcagttggatgggaaagagagagaagctgagagacgcctggcacctgtacagagtgaaacaggcaatgctgtgtaacgacagttgacagcaatgaataagggttgcagaaatggcaaaagagggcaccaaattaaccaagcctagggaagatgacgaagccagagtattcattaagggaccagatgaactagcatttttgagcaccttctgtttgccagggcatataagaacatactgtgatgaggcaccatgaaaacgacctttgaacagaaactgggtaaaaaacaaaagtaggcttcctcctcctcctaacacatctagtgcagccacattagatgggaagagccagaactaggcaagttattccactcccgatcctcagctgcctcggttgccatctctgcacctgcagggtgaacacaccccaatagcgtaacgtaagcatacccttagaatgatcctgtgtgggagatgcacctgaatgtgtggtcgggctggggaatccaggagtgaccaacccagagatttgtcccttatatataacagacattgtgccccatgcctgtcccgtggaacacaggccaaacagaggattgaggtcctgagtttgagttaaatgaagattgccaggtagaggttgttagggggagggtgttaagtgaaggtgtatataaaccacatgacatttgcaggtggttatggttttcctgcccagcccaccgccaccctggactgtagggaggtggatatcctgtccagcctactgccactggaccatttctgtattaaggtgggcagttgtactatccagcccgccatcactggactctctcccctatatgtaactcctaataaaaccccatgtctatctgttggctctgagtgtcttcttcagctcttgaactggtgcctttcctattgaggttaataggggttcagcatgacagcacctccacctcccatgcacagcatatgtacccaataagcagtccttacaataccaatagtttctatctgttgggactgccaattagccaggcatgtcaaatggaagatctcacttaatcttgccaaaaaaaaatgttgttcgttgttgttccttctattacagaggaaaaaacaaaggcagatggaggttacttatttgcctaaagttacacagctagaaaggagcagagttaagaatcaaaccccggccaccagctccagaaccgagcttgtgaccctggcatgggtatttccggagctctcgctaatggccagatagacgttgtgctaaagaaatgatctgtgtgtgttttctcatttaatatccatcagccccctaaattggagattactactgttacacaaatgaggaaactgatcttggagaggccagtcagctgccaaggtcacagagccagggagtgggggtggcttgcccaaggccaggctgtccctccaggtgaaggtaatgattaagaacacaggtctggagtgggtttgaatcacgtgtgttcagccgctcactggggacctggcctcagccctctgattactgcagggctttatactttctgagttctctttgctatctcactcgccctttcctcccatttctccttctggtccccttctccccttccaggcccccagcccccagcccccaccccacagccatctctgtataaatgtttgtggaatgttcaccgttcaaaagccacgttctagtttgaggctttcaattctgggaagaaaggggccatataaatacaaaaaatcaagtccgaaatgttgttgaaatgatattttggtccacctaagtttatacaaaaacattttccatgctctgatctccccacttgcctgttgggtagcccaagttccagatgaacggccttctcacctgcatgctgaaaccagccaggctgctgccacattaaaaactcagcccaggctgctcctgaaaatgtttctgccctcaagccacgtactaaaaattaaggggattaagggaactctagatttacatttaaaataaagagaaactcattggagaggctaatgcggcgtgcactggaggtagctactatcactaagcataagataaacaatacgagtggcattctggcccacgcctggcaaagtgcaggagtccctgaggaaaaggaatgagagtgcatcagcgacctcgtgaggcagtgcagctttgcattaatgctgcagctctggaggcggacttcctgggttcacattcacaacacctccaccgccaccacccatgagcttgggaaagacatttaaccattccatgccttgtcatctataaaacggggcagacgccagacacggtggctcacgcctgtaatctcagcactttgggaggtcgaggtgggagatcacaaggtcaggagatcaagaccagtctggcctggtgaaactccatctctactaaagtacaaaaaaattagctgggcatggtggcacgtgcctgtagtcccagctgctccggaggtgaggcaggagaatcacctgagcccaggaggtgaagcttgcagtgagccaagatcgtgcagcctggtgatggagcaagactctgcctcaaaaaaaaaaaaaaaaaaaaaggccgggggcataagtacttcctcagagggttgtcctgaggactgaatgatgtcatttaattcacattatatggtttgaatctgtgtccccaccaaatttcgtgtcaaatttatttatttattttttaaatggggtctcgctctgttacacaggctggagtacagtggtgcgatctcacctcactgaacctccacctcccgggttcaagcaattctcctgcctcagcctcctgagtagctgtgacacaggtatgtgccgccacgcctggctacatttttgtattttagtagagatgaggtttcacgtattgtgcaggatggtctcaaacgactgagctcaagcaatccacctgcctcggcctccaaagtgctgggattacagagtgtgccaccgcacccagccttcatgtccaaatgtaatcctaacgttggaggtggggcctggtggaaggtgattagatcatgcggacagatttctcatcatggtttagcacgtatgctgtgtggtgagttggctctcctgagatctggttgttgaaagtgttttgcacctgcccccttgctccctctcttgctcctgtttgcaccatgtgagatgcttccttcccctttgccttccaccatgattgtaagtttcctgaggcctccccagaagccagcagatgctagcatcatgcttcctgtacagcctgtggaactgtgagccaattaaaggtgcttttaaataaattacccagtctcaggtatttctttatagcagtgcaagaatgaactaaacacacatagaggatggagcactctgcccagctcatgccaacactccatcaatgttagtcttagcatcagcattatgttgcatagctgatgattcatatacacattactccctgcaataatgcccaagccttgcaagatatgtgcttcaatccccactttacagagggctatggatcccaaggctccacctgcagttgggttctacataagtgtcctctttcctcacatcttcagtaagtatgagacctccatcaatgcctgcttgggtgaggagcacaggtgggtgaaaggtaaggaacaagtggaactccatatccaaggtaggcacagtgtggaccagaagagcatccctagacagtgaggtgatccacggactgacctgccccaaggccagagacgcaggagtggaaagcacatggaaccatgagcttttataaggggcagggggcaggtgttgggaaattgcagaacagtgtttgagcagatgcaacagatccgaaggaaatagagattgcagttgaaatctgggtcaactggccctatcagctgcattcatgtgttacctccctggtcagctgtaccctccttcggattaggactgcatccttaccaatgctgagtcctctgggatccccagaggcatcttttcacccatggcaaaaaaaagaaaggtgggcagcagcaatgagaaccatgtccactaggtgaagtaataacgggtgcattgttcgctaaggacttaaaagtattaataaaagtgaccaaatttaactgctttttatcatcaccatgcttggtgattccaaacaatgtcagtgaaaacagttcctcctgctggcaggggggcggccacacccatcacaccccctcttggcaccgccatgttttacacactgcactcaacaaatattctctgaagggctgaaaaaaagggggctggggagggcagaaatcctgttgatttctgagcagcaaacacgtaaacataactgacattaagattacaaaatacatctttcaaggaaagatgtgccattctttcttgtgtgaaataaaaacactccccatgcaagattccaactgcacagactgatactgctatggtctgactggaaacaggcatcttgcattcttgtggctccgaaaatcactctggggtccaaggatttatttcctctccgggagtcagggacagataataaatacccctcatcagctgatcaattgctcgcacttccggcaagcacccatcactccccaccaaacacaccgccccacgccacctgaacaaggttaaagaacggactcatgactgatggtcggggggaactggcttcagaagaggaagttgaaaatttaagaaatcaacacgggcatttaaaagcaaagccttttccatgccacagaagacgtttgctattcatcttgttccctgactctgcttcaccaacttgatggaagatggtttaactgaataaaaaccagctatacatgaacagcggtgattgatggaaccattccaaacatcagccaaaatggcactgaaagatgccttgggcttcctgttaactgttttatgaggggaccaacagtttcccccctcttctttaaagaatatattagcagtacaagtactttcaaaaacagggtatgttataccaagagagaaacagaaggggaaaaaaaaggtaggaggtcttttgcatgttatatatgtatgaagggagttaggacctggcaaactgggttatatgaggctttttccataccagctctttggtttcacggtacatgatttaaataggttgtatttaattccatgtaataaaaactgtgccattaagtagttctcctgtacaaatgcaatgtttcaatggcaacagaaagaaatccagcctttaaaaaatgcacagatgctccaaatgagccatgataaagaaaggggtgggagcgggatgatctgcaaaaaagaatgagggaaggcagatttgtaccacttgtgctaagcgtggagccttaccattcagggagaatgagacgtttgcaaaatggcatcctagtcttgaatgcttcttaatatggaacggacgagaacagaggtggcaagagggttagaattcccctctttgttctcctttctggaatggagaggaccttttcctgcctttctttgctcttatttgaagaggttaattatgacctggaagcgcccaggcacttgggtctcagctattgtcgaggagaatattgtctgcgctgtaccgcaagaactaacttaggaaacattcaaatttggaactctttcagaagcctcaggaccgattccatgtggtggcattctatgggatgacaaatccccctccgttcccactacttgtctttgaagacatgcacattagtgaggcagaaaattcactcactttaaaataaaataagctggttatttggcccatctagaatacattcgtatctcaacattcaaatcaaaaggcccacttattcctgtcctcatcctggctctgaagccaagctcaagtgctctcaattacatggtagatttctggcccaagttaatatgtatcaggacttctcaaggtttgtacctttgacctagaaattctacttctggcaaatcaatcccatagaaataatttaaatgggaaaaatgctttagaaccaaagatgttcgtggccatggaaatgacgactgaaagagttagtgacaacctaaaaatacagttagaaggagaatgatgaactaaaccgtggttctctcattggtttactaacatgtccccattcaaagcactgttcaggaccgtctagaacaactggaggcatgcttttaaaatgttaagagagaaaagaaactattatccatatgggataataacaatgtgttaaaaatatacatatctctggaatatttgaattgcaggaggagaattatttagagataacaagcaaatccatcacgagtacatatgccacaattgtaacaaaacaaataaaacaaaatggcctgggcatttgaaactactgtaagaatatgtgccaaaatgctaaggtagatatatattggaggattttctttttcaatctttttttcaactttggagtattttccttttttatgaatatgtccctattgtgtatgagaaatagctaattttaagaagaaacagactccaagggggaaagaaaacacttttttttgctcctatgagaattcactggataagggtgtacatttcgggcccgcctacttcattccacaggaattagtaactgcaggtgcaagtgtgctactgctcgaaggctaagccctgataaggcctggggaggcccagagactaacaaatggtttcttccaggactttgctgctgattgatcactgcacttaatcctttccagagatagtactcaaaaggaccaggaaaggtaaatttaccaacgcaggccaacgtgactaaaaatagaccataaaaatcttggggagatgcaatgtggcaagaccatggtcttcattaaggcagggtgaaggtggaatcctattccagatacttcacagcttagatcttttgccaagcctctcacgtctcaaattccccatcatcagcaggagtcataacagattgcaaggaggtttaaatgagcaatacatgaaatatgccataaacggcaatttatcagcatctatgatccctaacattaacactgaccacttccttatgtgccagacacaaagctgagcacttcacatgtactgcttcaatactccgagaattattttatttaacccccatcgggaagagactattatcatctccttacacccacagggatgctgaggttacgaggtatcaagggacctacccaccattgcacaggcgaaaacaggagagccaagactgacacccccagcaggaggtgttccagccaccttggacacttccaccacaggctgagccgcagtgaagggctttcagaggggcagtccacactggacacaaacggtagagtggagattgggtcaaggacaggagcttcattatcttaaatgaattaagcgggaagagaaaaccaactaccacatgttctcatttgtaagtggaaactgagcattgatacacatgcacataaagaagggaacaataggccaggtgcggtggctcacgcctgtgatccagcaccttgggaggccgaggcaggcagatcactcgaggtcaggagttcgtgaccagccggccaacatggagaaacactgcctctacgcaaaatacaaaacttagccgggcatggtgggcacacctgtagtcccagctactccggaggctgaggcacaagaatcgcttgaacccaggggtggaggttgcagtgagccaagatggtgccactgcattccagcctggaagacagagtggactctgtctcaaaaaaagaaggaaacaatagacactggggcctactggagggtagaggtggaaggagggagaggaccgaaaaagcacctattgggtaccatgcttctgacctgggtgcaaaagaatctgtataccaaacccccatgacatgtcatttacctatttaacagccctgccgagtaccccagaaactaaagttttttaaaaaatgaaaattaataaaaattaaaagaaacacagatgtttgcatatcacatcagttactgcagatatttcaaaatatcatttacactcacactactcaaaagtataggtgttagtagatacactattacctcttgtgatttaatgtatatagaagaaacgtgtattactatagaacaataaaaatgttgatatttgtatttcaaaacaaaacaaaggaataagggcttccaaactttaaaatgcaagagagcatcatgggatgacgtggaagaatggacctgggtgagaggaggctaggatggggagagggaagggaaggctcaatgtctctttttttgtttttggttttttttgagacagtctccctctgttgcccaggctgagtgcagtggtgcgatctcagttcactgcaacctccacctcccaggttcaagcaattctatgcctcagcctcccaagtagctggaattacaggcgcacaccaccatacccagctaatttgttatttttagtagagatagggtttcaccatgttggccaggctggtctcgaactcctgcctcaagtgatctgcctgcctcggcctcccaaagtgctaggattacaggcgtgagccacgtgcccggctggctttcatatctcttattctttctgcttccgctctctcctgtcccctatagccatgggttccagagaggagagaaggctcgggagagcaggggactcaggaggtcacctgctaccctcacctttttaataaccctcctcaaaccctggttccacgtctccctcactaaggatttatgtctcattttcaatggaatgttacatttggtcagaccacgaagaaaactctcattataaactaggaaatgtgtggagagagaattatttacccaaggcagtgctcaatagtgttgcccgaatatttatttagcccacacacggagaagttgtgttaatgtttgccaagaatgtagctttataaagtaactgggtcaaaaaagacagcatatcattttacaaataacttaaaattgcttaagttaaatagctgggctctctcaggtttgtcttttcaaaaacgctgagaaacaatatccagaattatgtctaataaaatacaggtattacaaagtggctgtttagccattaaagaaaatggagagtgaaatctgaattatttctacccgaggcagaagcagacaagttaccaaaattatgttaggccgacgtcgcaattcttcaagtctgcagggcggcaaggtaacagctcctgcaccaagactctattaggagagctgtatttttcagtcaacaatgacagcattccatttctcagcctcaaatctagtgtagctatggggaattcacccaaaacatttcttttgctttatcagtggcatttgtctgcctcaaaagccttgtgagggagagggctactcgtgacgctgccaggcaatgctgttggaggcagctgatttgatggacaagaaggggagcgtgaccacctgggtcactctgactccgccctctctgagccaagtgaatctgagcaatgagtcataataatcatcaatagcaacagtggctgcgcgtgaggggcgtggtggttcacgccgtaatcccaacactttgggaagccgaggtgggcagatcatttgagctgaggagttcaagccagcctggacaacatgctgaaaccccatctctactaaaactacaaagaattagccaggatggtagcacatgcctgtagtcccagccactcaggagcctaaggcaggagaattgcttgacttccccagcttcaagaggaagagtctgcagtgagccgagatggcgccactgcactccgcctgggtgacaagagtaaaactccctctcaaaacaaacaaacaaaccaaaaaaacaaaagcaacagcaaccacaatcatcatcaccatcaaggctggaacaaggatgaggcaggcagctctgatagcaacaggaggaagcagaccaaggagggagagaaaggaaggcagagaagggaaaaaaaaacacaaatgataataatagatgctgacatttacggagcacttactatgtgcgggaaccatgctgacggcacaccgaatccactgaacaggtgggtaagtatcatgggtcatatcattctcattttaatgttgacagtcacaagactttcatctgtacaatgggggtactctggctcccaaggccagtgttggtggaatacagtgaatagaggtgagtaccgtgtgacagaggctgcatcagtaagcaggggcagccagccaggtgaggaacatgcccactgagatggggtcaggacgttgagagatccccaaattgcaagttgtcatcctgagacaagcgatacctgctggacactaattcattcttggagtctctccctctcagccctttggcttcatgttctgagagaatgaccagagagacccatttactcaacgcttctcaatgagacagggatcttctaagggcactgtcttatatagatccttgcacctgcaatacctgcctggcccagcctggccccgcaggttcttgtgaaatatttgcttatgagtaagcaaatgcataacacgagacggctgtctggaatgacagttgcgaacacaggaggctgctgagacttccagagactgtagataaaaacaaagaccctgtgaagttcctccgggaaaccagatgtggcagtgtgctagggctgcctagcgtatcagcacaagctcaacagaaactgactctcacagttcaggagaccagaagtcgaaaccaaggtgttggcaggggtgactccttgtggaaaccgtgccaggtttctctcctctttctgggggctgcccatgaccgtggcatctcttggcttgtagacgcatcactccaatcctgcctctgacttcacagagccttctcctctgtgtcctctcctcctttttctgttttgtttttggtgttattttttttttaagagatggggtcttgctatattgcccaggctggcaataactcctgggctcaagtgatgccccctccgcagcctcccgagtagctgggattgcaggccacccaccactgtgccccctgctttcctcttctcatgaggataaccgtcattggatttaggcccactctaaagcctgaatgatttaaccttgagattcttagctaattacatctgcaagaccctgtttccatataacgttacatctgtgattctgtgtgggtgtggattttggggagcgctattccacccactacccttacactgcaactcacccacactgacagcttcccttgccgtgtctgtccaactggcttagaaccggagcatggcatcgtcaccatggactttgagaattataaagacaggtgcctggtcccattccctgtgagtcttgaggaaaaaagaaaagtgagttcaaaaactagaagagccagcctggtgtggtggctcacatctataatcccggcattttggaggttgagactggcggatcacctgaggtcaggagttcgagaccagcctggccaacaatgaaaccctatctctactaaaaaatacaaaaactagccagacgtggtggcatgtgactgagacccacctactcaggagactgagacaggagaattgcttgaacccaggaggcggaggtgcagtgagccaagatcgcgctgctgcactccagcctgtatgacaaagcgagaccctgtccaaaaaaagaaaaaaagctagaagaaccaaatcactaatgcctaagcaagaacagagggatagaggggcctgggaagcaaggcctgtaagatcccttgacaataacacaccagtcccagagcaggaacacaaaacattatccctggacccagttctccatcagggtctcagcatgaagaggctcttccttcctcacggggatgggaggaccaccctgctttctttgcccttcccagaggaagggaacagcaccttccccatctctgccagcatctgtccatcaagagctggtcaaagcttagactcaggggatgccacagtccacattacagtgtcactgggccagggctgggaaagccgtgggagaaatgcagaatggggaggctgaggcaaagtcaggatgaaccaaaatgaggtgagcaccagacacagtggccacctgaggaggaaacacacaacagctgagaatccagggggatgcgtggccaggttagagcatcctggaatcaggcaggtacgaggagtccacgagtggagaggtgatgcaaatctgcaggccttggggacaagagcacatcaaacccttggggccgatgccttcagtattcctaattcctccatgttagaaaggtattttgggccaggtacttaatcccagcactttgggaggccaaggtgggcagatcacctgaggtccggagttcgagacagcctgaccaaaatggagaagccccatctctactaaaaatacaaaattagccgggtgtgtggcacatgtctgtaatcccagctactcgggaggctgcggcaggagaatcgcttgaactgggaggtagagatcacggcaagccaagatcacaccactgcactccagcctgggcaacagagcgaaactccatctcaacaacaacaaaaaaagtaatttagcacatatactgcatattcaaaatacctttgcggggtttggggcaacatcctataacaatgacatttctatttcttcgtgaaaatatgattattcagcctggccaacatggtagagaaaccgcatctctacaaagaacaaaaattggctgggtatggtggcacatgcctggagtcccagctacttgggaggctacgcaggaagatcgcctgagcccgggaggtcgaggcttctctgagctgtgaacacactactcactccagcctgggtgatgaagtgagaccttgcctcaaaaaaacaaacaaaacaaaatgacattcacactagaaaggagaaacagggacgctaaagctgaagtcaaatttcaccaccaataaatttgctataaatatacaataaatttgtttttgcttttcagatctctttgggtttggaataacaaaaaagggactgtacatggatatttccaagctggaaccgaggcactttctgacgaaggcagccttatccccaggaggtaaggtgtggaagtgagttgagggttgaggccgcaagactcagaccacagcctcctgctccaaacagccacatcacttaatctattttgtaaccaggcttccctcaagggatctggtttaatgagagaatttgggagctacaaaaaagacgaaaattgttgttggacatcagatgctggcaaactttttttgtaaagggctaaatagtaacaacttaggctttgtgagccaagaggcaaaaccgaggctattacagaggtatttacatacaggagagaaaaacaaatttctgcaaattttttattgatgaaattcaaaactttatgaactgaaatcagaattccatatcattttcctccttcaagaaataatattctcctctttatcttttttgcagatgattgaaaatgtaagaactattctgagcctgcaggccatagccaaaaggtaccggctgtattttgtccatgggcaggagcttgtgactgctggtctaggtcattcaggtcaaccaggggcctctcccagagtgagaaccactggtgattccccagagtgggaccagtgaaagcacttggctggatcagagggataggagcctggctgctcctaaaacaagacatacttgcctttgatgttcaagtcatttaagaacgcaattgcttcctactcaatttttcaaaccaaaataacaaatacgatatgagccataacttagcaaaattacgtgttttaaacagctctttcaaaaaacaatagattaaaaagtgcaatatttttaccccctcttaaattggaacatggtatagcaggcaggatacaaacttctcatttccattacacattttcagtgccatcttaatctgaatgacatcaacaaaatgcccaatgcacataaatcagtcagactttgaatcttcctgcagcctctgaacatttaccatggagctcaataagccaggcaagaacacagattttttttttttttttttttttgagacggagtctcactctgtcacccaggctggagtgcaaggcgtgatctcggctcactgcaacctccgcctcctgggttcaagtgattctcctgcctcgcctcctgagtagctgggattacaggcatgcaccaccacaccggctaacttttgtattttagtagagatagggtttcaccatattgatcaaggtggtcttcaactcctgacctcgtgacctcccatctcggcctcccaaagtgctgggattacaggtgtgagccaccgggcccagcctaggaacacagatattatcatcatgggacaagtcatccattcccagattccatgacccttctggtgtccactgtggatttcagcacatgtttaactatgaaactctagtcacgcttttgatatacaggttcatggttactagtgtcttatcctgcttgagccaagaatatgcactaaacattagacaaaccttgaattaaaatgggcaacccaccatccaaatggggaaagatgatacagacaagttcgtacgagtaaactacttgaaggcaattcctgtgcttaaaatggccactgaaaggtgtccctgacatggaaaggacaaaccatgaaatgacccttgaagctcttaattgtctgtcaaaaaagcaaagccaactgtcaaactgaaaagccaaaatcatcacaaaaaccctattcttcagaggcctcaaatctcaaactatctcccaccatcctttgtaagtatgtaaaggaggccaggaaactagcatttgctgagactttattctcagctttgtatgctttgcaaaatgatgtcatagaacacattgacagtgagaaaactaacgtattaacattttaattacttgccctatcacgagattagaaagattcagatatgagacatccaaagtctgtgatctgacaccagagtcagaggctggcaacctatggcccacgggctgaatctggcccactgcctgtcctataaataaagttttattggaacacatccgtccatttatatattatctgtggctgcttcctgctgtaacaggagagttgagaagttgcaacagagaccataaagcccacaaagctaaaatattgactatccagccctttagagaaaaaggccatgcccaggctcctgtgggtaccgctatgctacagcccctctgctgggggaaaccagcccactcacaggttcccagtgaggcggatctctgggcagttccttagtaattggtggctctgtgacttccttcccccaatcacctgaccatctagtctggacaatatgagcgcccatgacgtgaggacagccttgtaaacaggtggcctggctggaaagccttgtccaaaaggcacaacagtgactacactgaacccatccctgcatccttttgagagttagaaggaggcaattgcaagccggctgcaaaagaaaaaagacccagagacttagaaaccagtgaagccacgctgaagatgcagacagagagctagagacaagtcaggggcctctgttgcactccagacccggtccggaggcttttccatgcttaggggcaggattgtcagggttctgctgtccctttctttaacctcctttatgattccccaagagcatctgagtgcacctccactccctgccaccaggggtcagatgagccggcctggcaggcttgttccctccaccagacaacagcaaggaccaagattggcaaagtgacacatcctctccaaaaaagaacatgcagaacaaatcaaagaacacaaaccacgactgacaaacacagccacactcattttaaagtactgagctgtttgaagaaaggaagcatggcaaggccccttcctactaatacagtaacaacaataatactaaatattttataataattttaaattcttaattatttatgtatttccctccattaacatcacgaacatcattacgtgtgtgtgtgtatttttctcatttaaaaccagcagatgagagtaaaggatttctttttcctctcccccacctctttacaggactactgttaagttttcaagaccacccagaaagaaatttgaagttgggtttatatccttaaccctcagttagaaaaaaaagaaaagtgaagaaactgcatctccaagatcctgctatatcacttcagttttttgaagttaaatttgatttttaaatcccttggctgatgagacctgtgtggttttttttttgttgtttttttgttttgttttgttttgttttatcattgtacctctatttaaaaatagagacttgtggttctttttccaaaagcagtccaacagaaagtgaatggtgtcaatgcataataaaatgagagttaccttttgacttggaagaattattagcattttgattgatgggttcttagctcttcaaattcaaaaataccttattcaagtctaggagttttgcaatacttcggttctaaagattaccctttttcgatgctttgaaaactaaaagggcatatcaaatagaaatctggctgttgaataacttgtaagctctgcagagacgtacaaaaacatggcactttagccagcagtgtggcgaaagtctggggcccacactacacacacacatatgaactctcatgaccctcaagtatattcacatgatatatcacaaataccataaagcagcattgtataacagggaggaattgattttaaaaggcctacatcaaaatgaatagtcataaaagtatataacctagactggaaaatttagggattagagcattttgaacattatacctcaaatttataaggctgtatattaacattcacaaaggtttttaaagatggaatagctatgtacacagtgatttattctaaaatccagactcaaaaaaaaaaaagaatatgaactcctccccaccgtgtctggactaaaatcaataagttccctttaggtaattaaaatgctggtcccacgacctgcctcctattcccaggcttagaatgttaggaacactgtttctgctttgagaatggaagagagaggttaccctgatgcctctggggccaaacacaggggatacattttcccagtagaagaaacagccctgatcctcaagaagaagaacatattggcatattttagtgagactgaggcatacgcatcttggggtaaaaactgaatcatcaggccaggcacggtggctcacgcctgtaatccagcactttgggaggccaagacaggcggatcaccaggtcaggagatctagaccatcctggtaacacggtgaaaccccatccctactaaaactacaaaaaaattagccaggtgtagtggcggcgcctgtagtcccagctactcgggaggctgaggcagaagaatggcatgaacccgggagcggagcttgcaatgagccgagatcgcgatagtgcactccagcctgggcaaaagagcaaaatccatctcaaaaaaaaaaaaaaaaaatttaatcatcaaaggaaaatgtttcaaattcagggtaagctgacatggtacacatatacagcgaaatacacccagggaggctgaaagtccataggccaccacagcacgttaaaaatgtcctgttttacctatagtcaacaataataataattatatatttaaaaatttgttaaaagggtaggtctcatgttaagtgtttttaccacaaaaaatatttgtttaatgtcctctacatggctattatgattggaaaaggcataccttgaaagagatgaataaatctgcatatctgtgaaatgtcagttcagcatgttgatcgtcagtaacttttcagaacatttcagatatatgaaaatagcaccaatgtctgagtttgaacctgaacggtttcagctaaagtgatcatcttcagccaaaataatgggtatttctttcttggccttcttctacagacttctaaaagacagtggaagcactgaatatccttttagaaacaaacaattcaaattagctgggcatggtggcgcacgcctgtagtcccagcaacttgggaggctgaggcggagaattgcttgaacccgggaggcagagattgcagttagccgaaatagcaccactgcatccagcccggtgacagagcgagactccatcttaaaaaaaaagaaaagaaaagaaaagaagaaaaagaaaaacagctacagatattcattcctttttaatttcttgataaataatagacagtaagaatcacataagaagcagtctacatttttcaaagagtttttacagatcccatttatcttcaaaagggcctccattaggaaaaactaaattcaagtttaaaactatccattttattctcccataaaaatatattcagcccctggagataatctccaaattcctcagattttaaagttaatttttcttatcttgacccaaaatctgtagaaacaaggatttttcaccaacagtagctcccttttcataaaatccttatctaccaagatttacctctgcaaacctctacagtcctggttgtgagcccctgatggaagaagctagcataaagaagttcacaactactggggaggaacgacctgacaagttgcaagcaagaaaggagtgaaaaactgagttaattgtacaagatttgtgtatttataaatgcaggataaataagatcacgtagaaactctctttagacttcctccttactgctgtaattgaacgaacagacgaatgtgtttgaccgcaattgccctaatacatttttcccataaatacctgaaattcttcaattgtaagttttcctactctggcaattttaggaaagtgattcttgaggctgtgggtgaaataccacattcattttttttaaaaaaataggtatacttacttgtactttctaccattttatatatattctctgtttaaattgtgtagccctaatagactgcaaagacaatgataaaaaggaacttgccttattcacaggtacatcctggaacttagtaaagggcttaacctccatagcaggcagtcaagacttactgaatgattaataaaaacactgaattccatattgtgcaggaaaaaaaaatcaagattagacctcagaaaaattgacatgtctagtagaacttactatctgggcaaacttgaagagaagtgcaatgggaagcctcctcaaaaaagacattgaaatcaagatgggacccgttcctaccctggatttctctaatcagctactccttaagttcgtattttgttccactcagccaatggcaattccaggagaaggcaattgataataattatgttttctgccttctcttgggttatgaatttatcatgatgaaaagtcgagctactccgatgccacgttaacaatgaaaaacaccataaagacaaaaagaactgaatttaagcatttggattctgcagaggagtttattgaacagattaactaaggaaagcaaagctacacaattatggaaaacaggtagcaacactcaggctgactattttcgatggcacctgagagcggatttccaatgccctcatttctgtaggtacattatcctgtgttttatgttagtcacagctgcaagttgattaatttgcattcagaaattctaagtggcaaatgtgcatgcatagtaatatacatttttttatggacactgtgaaaatgccgaagccacatctcatagtaactcttgctcaaccagtgagtaaaatccataaaagagtttgcaaaaggctttgaagagtttggtttgaaaggaaaactgcaagagcaaatccctctcctccaccccagcccttaaaaacaaaactaaactaagtctgaagcaaaaccaaacaaagagaacagttgggtgatgtaagctgccagaatcataaatgttgtcagttcacgtcccagtcttcctgctctcttggcatgccaataaaatccagaaacaccagggatgactcagtaccacagtcagtgcgtaaataaggataaagatacctgttaaatccattgcctcaaagcaatcatgggagtttcttaagaatctgaacctcctctccgttttctgcactaaagagataaggagtggcatggagaatctaaagtgtggaaaatatatatcattggtgtgagaacacatattgtgataggtgttcccctccacagccccctagtctatactcctagctgctttatcttccagatcatgcctcccctgctcaagtgaatttgccttccctttcacactgaccttagaagtggatctgagaccatgcttcctgcaggagaaaacaacttttccatttgaaaacctttgcgaattacccacaactctgacaaaggtgctcagcagttgatagtattctttttggaaagttttatcaaccacttaagttaactgaagacgcctaacagcaggatatggtcaagcaaacatgttcatcaattaattcaaatgaattttagtttacttttatatgatttcccatgcttaaaactactaattgctttcccaggtggctgcatgaacatggcccaatcaaaggatgcaacagtcaaatgcttgtgtacatcatttacctgtccatttccatcagagacatcatggacacagctgaaatactaggcctggcctttgtaagttcattagagcatcacaaacataactgcagctattctcactgtttgtgactcgtgattcaaatgttttcacaaaccttccctggcactgcgtattagatggattgaaagatctgaaacgtaaggccgggcacggtagctcacgcctgtaatcccaacactttgggaggccaggtgggaggattgctagagcccaggagatcgagaccagcctaggcaacatggtaaaacccatctctacaaaaaatataaaaattagctgggtgtggtggcatgcacctgtagtcccactactagggaggctgttgcagaaggatcgcttgagccccagaggtcgaggctgcagtgaccatggtcatgccactgcactccagcctgggtgacagagtgagatcctgtttagaaaaaaaagaaagaaagatgttgaactatacacaagaaatgaaaagaaatagctgagatatggccttggggagaaagaacaaagcatcaactaatagaattcagaaagaaaaggaggtactcacaaggcactctgctaaggtttgactaatgggattccacatggtctgcatgtttatggctaaatgagctaccaacactgaaactgtccacttaattagcccccaaaacaagaagtacagctgtgagtctgagacctacagagactccaaaaacagaaactaccatcgcctcaagctaacactctaagtcctagaaatacatctgaggttgcaaacagtccatttcattcattattattatatatatatatatctctatatagatatagataaatatatatatagatatacatataggagagagagataaaacagaaaaaatctaaatgtctaaaggaccagatataagttaatcaaaaacgatgacaacaaaaacaaaggcttcttgagttaaaaagaatggaaaatatttaacagagttaaaaagaaaagcaatttgatcaagagtcaggaattgtaggttctagtcctggcctttttattctttttatttattcctgttttttttttcatttcttgtatatacttcaaaaggcaaaatatttataaagtccttctgagtatgaacactatgattcgtaacctcatctttcaatggaaaattcactagtatattaaattcaaccaatgggagaggttaggtagatgtatatcacatgctggaagaagctacagagagggttatacaaacgggacatgctggtattatgggtcaaataacaagtatcttagcacaaaccagccctggcataattcaggataacaaacacacaaggtgcaaaaatagaagtaagtacacatcaagtggacatggagcttcctgttagattgaccttccgcataatcaccacaaaggatttaaaacaattaagttgaagtttacggaccttggcacaaaaagccacgagagcctcacccaggtagagtatttccacacctccaggaagagagagtggtaaatgaagggtcttccagcagactctgaaatgaagaaggatgaaacttaatgacatatctgtcaactaatgatgttcaccagaaagtttcaattttaaaagttctacaggtgaatttttaagtcatctgaaatgtttcagtgaagagaatatgattcctaggccagtacagtggctcacacctgtaatcccagcactttgggaggccaaggtgggaggatcgcttagcccgggagtttgagacctgcctgggcaatgtggtgaaaccctgtctctacaaaaaatcaaaagttagttgggcatggtggcaagcacctgtggtcccagctgctcaggaggctgagtgggaggatctcttgaacccaggaggtcaaggctgcagtgagctgagatcacaccactgattccagcctgggtaacagagtgagaccatctccaaaaaaaaaaaaaaaaaaagagagatatgattcctattgactcatgtaaatgtctactgaggagaaaaattgtttatgcagctgtgccatctccccctgggtgcctgccttcccatccagtgaagaaacgatttcaggggtaaagaacaccctggactctgggaaaatcttcttgtgtcctgttgcctgccttctctctctagcaaaggctggaagagatgggccccaggggaggaaagagacatcaaggcatttgtgacaagccaaccagcttcctctccccatagccctgggcaggtgctgtttgatgaccataactcatttgccagagagagggtccatagaccatgttggtgtggtgccctggtgacatcttgtgtgaaatggaatataaataagcctaaaattctacccatggctgcactggggttcaatagaccagatctcccggtatgtttctttttgtttgttttttgagacagagtttcgctctgtcaccaggctggagtgcactgacacgactcgactcactgcaacctccgcctcccgagttcaacgattctcctgcctcagcctcccaagtagctgggattacaggtttgcgccaccgcacctgctaatttttgtatttttagtagagacagggtttcaccatgttggccaggctggtctcaactccaggcctcaagtgatccacccgcctaggcctcccaaagtgctgggattacaggtggagccaccgcatccggcccttgtatgtttctacctgaacaacttctcctgcggtccttcaagggtggatactgaagtccagtggacacatacatttaaccacaaatcgaaacaaatgctcccagtatacagtatgcaagaaaagagcagcattgattggaagaatgagagatattttagagatgaaaacattctttattccctcggtccccatgtgttccaatggaaaggaactactcctatgggcggagagtctcaggtaacacatgattacctcccaagactccttaaataaaccttggctcagaagataaaactccattaaatttatgtgaaaagtcattcttattcaactcgaattccttaaccttaaagcgtacaattcgcaagaggtaaacttagggtgtttgtctactggggataaaaaagagtaatgaacaggaaagagattccaacagataaaatgatttcgtgtaatattgcgagcccgcgtggctgtgattgcaagcacagatgaagagattagagcagtaggatcagaacgggaagctgaaccactggcattgtgaactaaagaagtaaaagagaagccatgccaatggtaacagaaatccctcttgtttttttgcttattttttcacatgcctgcttgtcaaaagaaacacctctttgtgtccaaagtaatttctttttcaactttgaaaggcaagggtgcatttactggaagcgctatgaatctatctggatgaaatccttaggctgggagcaccctcagcaggtagggaaggctgggggaaacgtacttcctgcgtacgacacacttatcagcacctgtaatagtgtgcccatcagcaggaaccacagcatagccatgccggcgtctattcctatccagtgtgacaataaatgaggccaggtgcacacctctgttacctattattctcccaagaatggcagcaaagcagtgagacctgagctatacaagaaaataatacaggaagaaaaaataaaggaagaaaggaagaagaaggaaaggaaaagaaaagaaaaggagaggaggaggggagaaggagagaaggaaggaaggaagggagggagggagggagggagggaagacaggacggacaggacaggacaggacaagaaaggaaaggaaagaagggtcttctttctaatatttttaggcagcatcagaaaaaaaaaatcattaaagtttttctgccagagtatacatccctgaaatgctgagatttaatacacaggatctgagctgtaagattaatggagattcaaaatgttggtacccttttccttgatggctgggaggcatcaggcttggtgcaatctgcaagctgaattaacctaaactcaaactggagagggcagaattagagcaagttaccccaaagggctcagcttgagggcttaaggctattcatctctagcggttcattccactcatttctcgaggatactagatgttgctgaagaataaacaactgaacagtatatgctttcattcaccaagtgagccacatgccaagttttcgttgttttgttttgtttttttaagatgcagaagtaccagtaaaagaatagcagtattagaataaaaatacaattagtactagaactatttttaaagtcctgagtaaaacagacaatgcactatttagatgtagaatagaagggagtcaaattataaaaacagaaacagaatataattcaaagagaggtgctgcttggaaataaggaaaaaatactaaaacatggatgccatgttttttccatgttaacctaatatttcatgcattaaggtggaataattacttgaagcacagttttcttaattagcccaggtatatttcctggggaaggaataacttattcaataactggtgttgggacaatgaactactcatctggagaaaatcagctggatccttaccaattcctcatggcaaaacaaatcctcaatgaatttaatgatttcaaagtcaaacatagcacgttcaaccagtaagacatatgagtcaatataatgttaccatggagaaggatttttaagcgtaacaattaaaagcagagatcatagaagacaggctgatagatttggttgcaatagattaaaattaaaagacaaaagtaaaacaaaaattaaaaacttaaagacaaaaaaagcagggtcatgagaaaacatagtcatacacctcataccaacatttcagtcaataacgaactattacacaatgccgatcccatcagattataataccatattttcactgtaccttttctatgttaggtgtgtttagatgcacaaatatgtcccattgtattacaactgcttacactattcatacagtaatatactatacaggttcatagccctggaggaagaggctataccatatagcctgatgtgtagtaggctatccatctaggctcgtgtaaatacactctatgatcttcatgcaatacagaattccgacaatacatttttcagaatgtatctcccttgttaagcgatgtgactgtcctgtgatatacataaccacaggttaatgtcttgaacatttaaatagttcctgaacacaaaaaattcttaccattcacaaacgtaaagacaccaagatagaaatcagtcacagaacataatagatcatttgcaaaagaaagaaattgttaacacatcaataaaaaataatgtttagctcactaataatcaagaaaatgcacagtaaaattagattctacctttctcttactactcactttagaaaaacgttacttattcctagtgaagatactggaaaatagtagcctcaatattcaagaaagcaatttggcaattaatctcaaagccttatcttattcttggaaccagcacttcaagcgcaccaaggaatcactcactggtgtgtactacaaaaacattcattgcaattccattacaatagagaaaagctgtgaataacctgtatgtccaacaacaggggattggttaagtaatcatgactcacccatccattaggacattgggcagctattaaaaataatgctgttgaagatttagtgacacagaaatactattacatgaaaaaaggcagtttcttgaacacttccatttctttttttggctggcttttttttttttaatttttaaagagataatatatacgtgtgtatcaggaattacatattggaaatgaccaccaaaaaaatgacttgttccacttaacaaagaggaaaaacaggccggacgtggtggctcacacctgtaatcccagcactttgggaggccgggcaggcggatcacgaggtcaggagatagagaccatcctggctaacatggtgaaacccctctctactaaaattacaaaaaattagctgggcttggtggcgggtgcctgtagtcccagcacttgggaggctgaggcaggagaatggtgtgaacccaggagacggagcttgcaatgagcgagatcaccccactgcattcctgcctgggcaacagagcaagactccagtctcaaaaaaagaaggaaagataaagttgatgccacctttggtctcttcctttctactgacaaatcatgttacttcagcagtcacttactccatctgggcctctgtttcctcatctataaaacaggaatatgacaacttccccaccttagacatatggattctatgaatatagtcttgacatgtaaatgctattttgttgtgctgctgttttggaaactccgccattacgccagccatgtgaaaatctttctcagctccatttgacaaaggtggccactcagctgggctccaacactcttccccacctctctgccactgaactcaaacaccctctcctttgggaaacccaggctggaaactgaaagatggctccatcctcttgcttcccaagactctgcaccgcccagggacgctgagcactttcatgtttcctgccacatcattcagcagcccctgccttccaccgtccaatgtgcctatgctccttctctttgcctacaccaccttccacttggtaggagctcaagcatcccccatcaactcttgcagacccatcaacacatccctggcattcttctctgacctattagtgcttcaaggtgaaaagcataaaagggcatggtccacacaagtgcagggtttctcagcctcagcactatgacttttggggccagacaattctctgttgtaggatgcgcctgtgcattgtaggaagttcacagcatcccttgctcttacccactagatgctaatagcagcctattctcctccaagatagacaacccaaatatctccagacaagtgtcccttgatgggcagagtcacccttggtacagaccactgtacacagtgagaaaggcaatatatttatttctgctactgacagtcacagcctcaagcagcaggtacccaaatcacataaatgatcaccgcaaggacacttcttgggcaggaagtccatgccagagcttcaaccagaatctcctgagactgaaaggggaatgacagggagtcgtccctccctgcattcctctggctcccctctgagccttgagcaaaaggaaggggacagcccctgaaccctgagcctatttgcatctcctctgagagcatgttctggaggcgctccacgcgagcgggaagatcttttgtgagattacttatctggagcgcgtgtcacttcttcagcacataaaactgaaatacttgaaatagatgtcactacatttgtcatgaactgacatggccattaatattacaaattcaccatggagaaacgcttccagctcccaaggtataaactgctgacatcacaatttcctcttgtaacaatgggccagcctcgccagggctataaatacgaagaatacaggctgattaaatggtaaaaagtgctgttcacagggagtctctttccagggctgacctagcgctgtgcctaaagttaacaggtaccccgatgtctcggctgcaaaatatgtattttttctctctttcttcaggaaaaagttgactgttgcatactgtcatttttttctcctcccgtgagcaaatggcacactcattacaggacatgaaaggctgtgggcacaggttgtcccaattctgttgccactcagctagttggacttctcctttttttttttttttttctattaagtctgtcacagccaaactctcacccctaatgaggcacagctgggcccttggccctgaagaaaacgcgttggaaatgaactggaaaacacttggcctccctcaaacttcccaggagacagctagcccctcgtgccccctgggagttggcttcttttccagcggccatcttcacaatcaagcggaaaatgccattgttccaaagtacacaataggttctggtggttttcaaacatcctccaataccagtgcaaatggaggggcatctgaggcgaattccacaggatgttttaggagcccaaggccttgactttcttttctcggcagaagttttaagttccagtccccaggcttcattcttatattcttggtttggaagacagaggcagcagtaagaaaatagattatgtataaggaagcaaatagggcccaatgaattacccaaaccaaacaaacaaagtctgctttggaaataaggtttggagggaggtgagacctgtatgcatgagtgtataaaatcagagagaaatgtgtcaaaacaaattacaaaccttccaaatacgggattacacatgaatggatggtaataatcacactcactccaaggcaatctgtgtattacatcttgcatttcatcaaacaaggcttagctcttggtcattaattagcaacctcggttccagataccaaaatatgaggaaggctatagtactcggtcctgcttcaatattgtgatttgtttttcttatctacgtctctttttcttcccttatttgctcacaatgccttctgaggaaagacaagacctttcttataaaaggaaaaatatccagtctctacccacagagtccaccattaatggaaataggagattgctttcttcaaagtacaaattaaagtaacgtactaactcctttacacataacacaagaaagctagaggaagttttagtatttatattacactttttccttcttcctcttttctcaatataggaatctttctgtttatgaaagctaagccactccatacaacgaacagtttactccaatacaaatagaaattataaaaatataaaaatcctactaaaccttttaatctctaactttccaagcaggtgaattaatcagaggacattagagatttattttctttaagctccaacagtaaagagtgtttcaaagtcttctcaaagctgtagagatttttaaaatccagatgaaccgagcttaactctgtgatgtgtatataataaaatctactccaagattcacctacttaaagatatatgatacatttggatagagaaaatgaaattttaaaatctaaatacatatgaatcaaatggttaaaaaattaaataaagtttcttgcttagagtaataaatgcaagcttctcagtggatatccttaatcctgatttagaatgagtccaaaaagaaattgccagagtgaataccaggtaacagaagaaatgatggcatgtttctctgtagaacaacctcccttccctagccgctaactatggtggtacttactctcacattctagctcagaactgccattctggtcctttcattcttgttagtcataccagcattgtaaactgctttccacattaaaagaaaagtaaatggttcacttgtccctaaacttttgtcttacacaagacaacattaagcatatttcaaataaaaatgttcaattttcgctagcttgttaaaggttaatacccaagctaaaaccactgggttttaaaagatggttaaactgaacgaaagctttgattttcaagttatgatcagaaaataaccatgggagactgtcgagaaattaaaatatagtcagaaagcctttaagtattacttagcaaaacagctatgacccaaaatagatctgttatatgtttgttattcacttcagtaatgactgaaagtgaataaataaaacttgtcggaaaaataaggttttgaaggaagataaaaactgtacatttaagtgtatgaaatcagaagacataaggtaatagaagtatccatcacataactggcctttaaaccatgtaaaactcttgatacccacatgggaggccaaagaaacgcaatttccaactcaagaaactatcacacaaatcccaacatgttctagacaccactggataagaaatttgagggagtaccccgaataaaaaacattcacaatcattcacaatcattcagcattacctcccattctacagggggataatcattttaaattaattctgaattcatcaaaatacagttcacagaataattatactggtaagattcaggagacactttaaaagagtattatagctttattgtgatatatatagttcaaatcattttgcccatttaaaacgtacaatgtttggtaagtttcagtacaatcgcagatatatcaaaccgtcaccacagtcgagagaagtcaagataaaacaagagaacaggaagagaaagaaaacaaagagaaggagagaaggaaaagagaagagatttggaggtacatattccagggtggttcttggggtctttattgttttaggacttctcagtattcgtcgtggtaacagagcttttctgcctggttgccaaataatgtcttcccaaataatatgagagagaaagcaaaagagaatgttcattcgcaaaactgagactcaccgagttaaaaaattaagttgtacagatcagaaagtaatcataggagacaagctctgagagtttttcaatcactgtggggttgcatcaatttaagtcatgttacattaaagagaaaaatgtctgggagagtctcttcctgtcactttagattgatttgttgttgttatctggctgtgcattttgtcggcttcattttacattttaaagatatgcttaatgtccataaataaaaaactcataacctacgactttttctccattgtccagagttagtagatggcgcaaattaacaagaagagcaaaacactcaatgttcatctagattcatttaacatattaactaacttccttggagtaatctaacataggccaacttcaaatccagtgttttttttttttaactctgctccacttaatttaagagttacacaaaatcaatttgtggttatctcccttcacctagtctctatcatgtaggagggaattggaaaattccatctggtgttttcaatgtttcctcaagcgcaacttcctttatctcaccaagatcttgttaaattgcactgactttagtcctggacgccaaggacttctaaacatcaagttgcataaaagtgacatttaccaatttaagtgataagttttcaaattgtgaagcatctaattgcaacgataaatccacttgctttcctctatggccagacatctgtatctttaacaaacaaaagtggcagtttaaaacaattagactcaaaaactctaatgaataaaaatcactgtccctacagatagcacgtaaattacatgcgcaccgaagcgtgcttccacactgcacggcgcacactggccagggacattcgaaccagaaagggccctggccccaaagtcgtgctttccctactttgctttctagaatgggaccacgctacacatcataaatctagagaacacgttaaaaccttgatgtgcctgtcattatgtagctgctttatcgtgacattttttttttccttagaagaaggagaatagttttccttgggttggcggtaaattttaaaaagcattttctgtgacctcatatagtcaaatcatgaccctgtcaaccaacagcctcctggcatcctcacacacccttagtcctatagagttacatctacacacatttacatgaattgtcaaagacattaagaaaggcaagcaaaggccaggcatgtggctcaggcttgtaatcccagcactttgggaggctggaggaggactgcttaaacccagagtttgagcccagcctgggaaacatggcaaaatcccatttctacaaatatatatatataacacacatgcacatacataaatataagtataaatcagccaggtatggtgacacacatctcagtacaagctactcgggaggctgaggcaggaggatcgcttcagtctgggagttacaggtgcagtgagctgtgattgcaccactgcattctagcctgggtgacaagagtgagagcctgcttaaaaagaaaaaagaaaagaaaagaaaggcaagcacagggagggagagggaaagtaaaaaattgagggggtgagatacgttggcctctgctttttgtggaaaaggaggctgctgcaaaatacaaggaagaaaccagcatatgagtgtccaaactgagttgccaagggcatgaagttggaaggatctttgagggtcatttgacttcactccacttccagcttatatgctgacttcgaacttgacctgtgcagaagatgagtctccacggcctgcacagcacacagaattatttaccctatacccccatatattacacccccttccccggtaagtgaagaaactgtctgctgaagaatgcatgaatcttgcctttaacgtctcaggcatgtgttaaacactttccgagacaccggcacctagtaactttcaatagatttctcttctgagccctctgttaagtttctcggtcttattaaggtcggaagcccagcatctgggagaagagagtggttcagctctcatctcatcgcaggatcacatgtctcaacacagccaggatttaggaacagcaatattccatcttaggcattcaccacttcatacgattatttggcaccctcgatttttgttctgctgctcacatcacaaaaggctatttctactttatatctttagcattttccccacaccagagttgtacctatatcatgctgtttccaccagcaggaaagtaggagtgcaatcagctatcctcgctttggccagggtgctaggaactgataactccacatatcctgcaaggcaggcaggagaagttaggaagatcagggaggaagggaacagacttttatgactgtggatgcagggcaatgggctctcacgtgtggtagacaaaatgatgcccatttcccaaccaaagatgtccaggtcctaatccctgaacccgtgaatatggtagactgcgtggcaaaggagaattcaggttaccggtgaaattaaggtgttaattacctcgcattaaaatagggagaggggctgggtgtggtggctcacacctgtatcccggcagtttaggaggccaaggcaggcagatcacttgaggtcaggagtttgagaccacctggccaacatggtgaaaccccatctctactaaaaattagctggcatggtggcatgtgctgtggtcccaggtactcaggaggctgaggcaggagaatcgcttgaaccctggaggcggagttgcagtgagccaagatcaagccactgcactccagtctgggcaacaaagcaaagctcgtctcacaaataaaataaaaataaatagggagaggaccctggttatctaggtgggccaatgaaatcacaaagatccctaaaggtagaaaaaaaaaagcaggagaagagtcctggtaaatgtgaccacaaaagaaagacagagagatgcaatcttgctggctttgaaaaatgaagaggcatagcagaggaatgtgtcagcctctacgtcatgggaaaaggccaaggaacgaccttccccagagcctccagaaagaaatgccaacaactacattttagcccaaggagaaccctgtagacttctatcttacagaactgaaagacaatacatttgtgttgtttaggtgctacactggtataatgtgttacagcggccagcagaaactaatacacttggaaacaatggctgtaacgcaccatcagtccactggttttctaacctgcaagtgttcaaagtgttgatttactttaaaatattaagccaggctctggggattataaagaccaaaaaattgtatctattatcattattacccccccattgtttttatgtatatatttattattttacttttcagctgttcttatttaatgacaagaatcagaaacaaattgagatggaatggtccacacagggcccatgctgagacagcagtgtggctgacggatgagaccattggttagccatgtgtttgtgtctctgttgtgcccttattcactgtcctgccaggagccagttagtggctcatctgtgaaatgggaataagaacgtcccaatatctcacagatcattgtattaatctgttttctttctctttttttttttttggatggaatcacccaggctagagtgcagtggcatgatctcggctcactgaaacctccacctccaggttcaagcgattctcctgcctcagggtcccaaatagctgggattacaggcacacccaccatacccggctgttttgtatttttagtagaggcagggtttcaccatgttggccagatggtctcaaactcttgacctcaagtgatccatctgcctcggcctcctaaagtgctgggttacaggcatgagccaccgtgcccaacctgtattagtccgtttttgcactgctatgaagtactacccgagactgggtaatgtataaaggaaagaggtttattgactcacagttccgcaggctagggaggcctcaggaaacttacaatcatggcagaaggcaaagcagaagcaagcacttcttcgcaaagcagcaggaaagagaatgaaggccaggggaaacttccatttataaaacatcagatctcacgagaactcacgtgctatcacgagaacagcatgagggaaactgccacccgggccaatcacctcctaccaggtccctacctggcacgtagggattatggagattacagtcaaaatgagatttgggtggggacacagccaaaccataccaatcatcatgaggattaacaagaggaaacactgtgcataaaacaccacgtgagcacaacacctgatacatagcaggtgttgatatggggaagaaaatgacccatgggacttaagtgattttacaaacagcacacagtaaagagcaaagccagaaatatcatgcaatcttccatcctctaacactctttccccagcatatcctacatctactaccaaaccccgccatgtctcaaaccactgaactttggcccatatggctaaacagcaaagacaatcctcttaatttaacccattctcatggtagtctctgtaaactgcttgaatatgattaagtatcaaatactgtcatatcagtagaactaaaatataccaatagtatccctagtttccagcccagctccaaatttttaaacgacaaaccttttttttttttggtaatatttattcattgactattgatatttaactgttttcacaatgataaagtagctattaagaaacaaataaagacataaaatcaaagtatgaagccaactgagggtcaaactgatggagcgttgctgggcattaaggttacaaagaaagaaaggccttgccttgcttttagcagcttagcaactttttcagggacctgggacacgaatattcaaaaaagaaagtgctaggcatgtggctaaatggcatgattagaagggacagcatattcagagggaggtgcaatccctgaggctgaggtccaggaagagacttcgggaggagatcagacttggaggatgacaggggtggagtgcagacagcgaccacagagctgacagcagcagacttcgattgtgcacagaatgccaccactgttgcttggtggtttatcatctaaactctcacaaaagccctaagaggtaggaacattacaaaccaaccaccttttacagatgagataattgaagttcagagaggttcagtactggctagtgatcgcacaggtaggaattagcttgaactaggacccctcggtctgatcttgaagcactcaagaggagctgcggtgactttgggtgacaaagcactgacagggagatagggacctgagacgtgagggtccagggggtcagtctgcaatgtggagctgatgtggacccagtctgagcccagccctaggcagcagggcatgggcagcaggggaggcaaggtaagtctgatggccaggtgcccctgccccagtggctgggaggcgcagactctggaacacaggttacacctccatttcagtgcttagaagagcagaggcagctgtacaggggaggcgcgggccacagcgtgcatgctcacaccccggacaggtctggagacagcctcctgaaaccgccctgggggccccaaagccctcaggtctccagggcttgtcactcaggcaccgaatacacttagcctaattggaattattccttcttcatgaagccaagcaggttgtcacctagttccctgggtaagacatttcagcttcattttgcaattacatctccctggtatttgtcatggcacagaagtgaaatttcgtctctggtccccaatgtcatcttttccttctgtttaaaatctaggtgctatgccagtttttttttaatctgtaagttcttttccaccctctcccccacaaaaatcctgcaatatctgccaattattttctcagtcacattaaaaatagatgccattcgcattgccactatggcagtgtgagcgctgctcataagtatcctgatcttcaattctttagggcacacagtaggactgccttatctttcgaattggggcatgaccattgccttgctttcaccaatggattgtggggagagcaagatttctgagtggaagtgcttaagccagacactaatcccccatgctcccttatatagggaaagaacagaggcacatgtaagagatggtgctgaggtcagcctggatccctgaagattttttttttttttttttttttgagatacagtctcgctctgtcacccaggctagagtcagtggcatgatctcagctctctgcagcctctgcctccacggttcaagcaatccttgtgctcagtctcccgagtagctgggattacaggtgcacgtcaccatacctgactaatctgtgtattagtagacatggagtttcaccatattggccaggctggtctcgaacttctgacctaagtgatccgcccacctcccaagttgctgggattacaggtgtgaggcatcgggcccagccaatccatgaatgactttaaagcacagccccttacctcccatctgtggtcagatatcacgatgggaaatgaattcaccatgctaagccactgagatccgggcgtgtttgttacagcagcaactccagtgcagctggcctgagaaaagccattttaagcagttcaagttccatcctgtgtccatgtctttctcaagaggttggcttttactttgccttccagcattaccagactgttcagagttatcaagggcagaccaggcaggcctcccaaggggcaatatctatcctaaatcttggtcctttttggttcctctctatgctgcataccctctttcgtggacctaattcagatttgagaacaagaaaatgtttctcaccaccttgtcatgaaggggacctaggtgaactcacccaatttcagctacaaaattcaaatgcagacacagcccatctatcagtcctcatgggactttcagaatccaatataaactacagaggtagtcaaagaaggggttgttcctccatttcccccggcaaatcaccaccattcctggggcctggatgctttagggatcacagtaggattacactccctgtccttttgaatttggggatggccattgacttgctttcgccaatgcaaattgtttctctgaggttacatctattcctaccagcctagattgatcagcctctgccctcagagaagaatcaatccccccttttccatggagtgagctttccttctgtgacagcactagactgccaagaagcagagagctgaaatgctcccagcagctctacagctgaggccaggtgctagcctcggaatgaggctggactgggcagggcagttcccggccctgcattccaaacaggatgctcactgcttgctgctcccacatgcctttcccaaatacaccaaataataacaaaagaagatgtcaaataaatagagctcccatgattatgtaccatggtagcaaataaatagagctaccaggtgttaacatgcattatctccagtgtccaaaacaaactcagctcagagagggtaggggcattaatgacagagcctggatttgaacctcgttctttccacaccatattctggtccctcccctggtgcaaccttcctcccttcatgcatgttctttgagttcttctccctgctgggaagacttctccaatcctagctgtgctgcaaagccaggttcccactgcaaagccactccgttatcattctcaccctgaactcttccttctggaaccacttctctacggtgttggtaacagagtagcacactgattctaagcacacagtccagcagcctcttttttctatatttccaagacataatgtagtcttgacaatgcagcagcagcagcagcagcaggagcaacagcaactgccaagtctgcaagtggcttcaagatgccggggactttattaagcagttcccaggtgtgatcgcttctcttgcactcatacactcagctcaaaggtcacctcagcaatgaagtcttccccaagacctgacaagatcagtgctcagcacacagtaggcccacagcatgtatttgatgtacaagtaacaaaaggaagaatgaatgaaaagagctcttcaaagccatgcctctggactccttgtgcgtgtgagtcccctgccacagccataagaagtctccagcggttctaccatcgccttcttagaagtaacacccaccctagactcgtgggaaattggcagcgtgggaattaaactcacaagtctgttctcttccactgagctgcactagggccagaacccaaaataaattcctttcagcctctagcctctcagtaggaatatctgaagtatctttaatcaaactttagaggctgaaatgcccacaattctaaaaatgcctccagttactatggatttatcagtgaagagaatgaaataagaaaatttgtttcatagttaaagccaaggccactttatcccagatgtacttaaatcattagctcttaacagaatctttaactataaatatactaaatttggtagtaggatagattactacaaaaggaaattaacactgccttagagaatgtagataacatattaaaccacagatagctactttggagaattataactgggtagacctaacatttttaaatggatattagagatgtgaaatgccacttggccaccctctgaaatgcaattgaatttacattgattaaggaaaaaaggggaaatctaatattatataatgccttacattaaaaactttaaacaagccccaaagtgctccttaggaaacaggttttgggtgactaagcagtgtgtcattagccctctggtgagaaacgcaggatttagttccttatgagagacagagaaagagagagagacagagaaagagaggagagtgtgtgtctgtgtgtgtgcacgcgcgtgtgtgtgtcaggtttcaactgtgggtaattagcacttgccttccaaagagaccagcagcaactacaaaagtttgcagggctttgtcttagcctgtttgcattctccaaagcaaactgacagtctcatgatgcagggcattaaaaacctcagtggtatcgactgcctgaagccgatgcttccctgttaaatacagcatggctcaataagagctcttcaatatacaatttaatttttctttcatcttgatccacagcctggctcaaatgaggaatgctagaatagatgtactttgaatattgaagcaagtctttataaataaactatcacccttgtaatgatttctgtcataacatgacaaaatagatgaagctcggcgtctgaacttcagctcacacgtcatttttccaacatcaccaggacccacaatttttttttttcttttggcttttctcgtacttttttccagttatctctgaataacattctgctgtttaagaaagtttatcctttcttcttttcattccctgtgtggcaattcttcagaaagaacgaagaaattactattctgctacttacatgtaagagaaagaaggtaacttataaatgaattatgaagtcttacccttggaaagacatacatatttcatcataaatgtgatccattacacttattctcatacagtatttatatttgtacatgattattcaaggtttcttttttttttttttaatctcgcaagcccatactttcaaaagcaaatccaacattctcctttaacctgtaaggctcagatagaggatacaaaaggtactcccaattgactccacatgtatactctctctctggatggaggtattagatttacaaagaatagcaagaatcatgggatttctcaaaggtgcacatattaacagaacaatgttcaaatacctgcatgagcttgctatgagtcaaggaggaagacgtttcctttgggcctaagacaatttcttatattgaaacatattcataaaaaacagacttgacaaagttaatgccttggatagaattgtgtagctctgacatgcatttctgacagttggcttgactagatgaagaaggaacagggctctctctcccgaagtggataaagtatcagtggagcagctaatacccattccctttctgatcaaatcattccagttggtcttttcgggctgcagagcccttgctgagatctcaggtaacgtcacagtcacatcacgacaacaaatgtaaacttattaaaatttactggttttacccattgtatttgattttcatgttataatttataacctatttaaaaattcaaacagcatttcttatttttcaacttgatcactccctatttagcatgaaatgacattacacataaatatgcatatgtatatacattcaaatacaagcattcccaataggattgacaaaaccacccacattttaaacacactccttccattcccattcttctttccccagtgctgcacttaatataatttggaaagaactaaaaaaaataaataaataaataaaaagcttaagacaatttttaattgtcagagatggagcacttagaatttatagtaattaactagtcttatttcaaataagaacattaattggtatgttcagaaaatctgcagcactgcaaaatttaaataaacattacaaagatatcatttacaactaatctatatttaccattgaagtgagctcaaactatatttctttctattatgcttttattggctacagcacacagtaaatggagtgtttatgcacagcttcctaaacagctaaatttataaaacccaattacataaattaattaggatgaacgcatgcatttatgcctttgtttgcaactgcaacatattaaacatgacaaaattataaagacaccctaaaagaaaaaatagtgccacgtattcatattccataacaggttttttgagatttaatttgatttgtctagtcctaagggtcgtgactcttaataaatacgcagttctcaccgtttcatatacatatgtaacggtatgtttttatgactcctaaaggaccaagaaatataaattcaagagtatttatttcaagattcagagacagaatggcaaagaattactcaatgttatttctgccttcgttatctcctacattgttatcaaagacagctttttggtaattgaatgattcgccatcccctagctttattatagaaaacgtccagtaaaacaagcttactcgagctccacgaaggaataaaacattggcatatgatcaagctagccagaagagcactgctaggccagatggagaggctcatgcctgtaataccagcattttgggaagccaaggcgggcgatgacctgaggtcaggagtccgagaccagcctggccaacatggcgaaaccctgtctctataaaaatacaaaaattagctgggcgtggtggcaaatacctgcaatcccaggtactcaggggctgagctaggaggattgcttgagcccaggaggttgatgctgcagtgaaccaagatcagccactgtactccagcctgagcaaaagagactctaactcagaaacaggaaaataaaataaataaaataaaaaagcatggttgataacagaccctttttttttttt

SEQ ID NO: 5023 - DNA, 36297 bp, Homo sapiens
  misc_feature (11391)..(11410): n is a, c, g, or t
ggtcagctgccctgctgaccctgtttccttggctccatgatccactctgctcaggagattccagaggaacttacagccccaacatggcccctgtagggcctttccccctgtgaagactgctggtcccatggaggctatctccacagcctcctgccttgtccctcttcccccaaaccctctctccactctggtgaactcacagacccaagacttctgagcaaagctgctaaagtgggatagggaggctccacatattccagaaaaaggaggggtaagttgtcaggggggttgtaaatactgagtttggttcggatgtgttaacctggtcgtggccacagcacatccaggaagacaccaggggcagcaggctctattaaacagtgggaagggctcagcagaagtgcttggcaggccagccactgtggctgctaaacccggctctgtggccatagatgctctggacctagagatgccctcgtcacatgatgggcagaaggcatggagcccaggccttggccagcactgactccacacccgggctagctaaaggacaacgtctgtgtggagtatcctgaggggggatgaaaaagcagtgcctactggggaccatgctgcctgggcagaggagaacccatcatcattgacagacggaggatgctgggccccagcaatgtggcctctggcgtgtgtcagggagtgtccatctgattcaccatgaccggtaaataagcccttcgggtcacccaagactctacactttcccagcatgctaatgtgagcaattctcttcccccagaaccaggacagttggagggaaggtgtgtaaacagggaactccctgggttttattctggggacagagccaacctgagaagcatcccagccgaaggactagtgctgatgggtggggacctgaggcctggatggagctggaggggagtttgtcacaaatgcgagaaggaaccacatgaatggatagacccaacagggtccatacatacagggaatattattcagccctaaaaaggaaggaaattctgacccctgctacaacatgggtgacctcgaggacatgatgctccgtgaaataagccagacacaaaaggacaaatactgtatgatccactcacagggagcccctagagtagtcagattcatagagacaggatggtggtttccagggctgggggaaggggcatggggagttagtgtttaacgggggttgttgcagtttggaaaataagaaagttgcagggatggatgctggtgatgtttgcacatgacgtgaatgtacttaagcaactgaactatacgtttaaaatggttaaaatggcaaattttatgtcatgtatattttccagaactttaaaaggaaaaaagagagcactgcaaccagagccaggacactgggccaagatggaggcgcagaggtgaggcaaggctggcactgggcccatcagtgttccctacctgttctgccagcgtgggttgggaaatgtcgggccaggtgtgtggacgtggaaggtccagatgcgcctggggcactgggaggaggacagcagcaggcaaagggctgctctcacgtatgttctgcccccaccctgaatctggttcctatcccgtttttgcccatggctggaattagccagttcctcattgacagaaatgtctctgtgaacagatcaaggtgtctggcaggttggcagagaagtgagacctcccacagagtcagtcctcatggtgctgggtttggtaactgggtgagggatgcagctttcattttcccagtggtgtagggagaagaggtcaggctgacactgtctggacgcgtgtgcccacacagagctggcatggtcaggggtggcaacgatctgtatttccagctttaagaggaaatagacactggagttcgagcacctccttgctccccttcgtgaatgttggggtacgtaccatcaattcttgtgattcatggtggttacatttataaagtctccacatacactgatcagccaagactgagtcattgctcctaggggacggatggggttaggttccatccaggtctgggcacatttttgacaaatgatcgatacataaccttgttttatgtgtgttcctggtaaagacaccgtaatcgataacttgttttttttttttgttttgagacagagtgtaactcttcgcccaggctggagtacaatggtgggatctctgctcactgcaaactccacttcccgggtcaagtggttctctcaccccagcctcccaagtagctgggattacgggcatcatgcccagcattttttgttattttgtagagatggggtttcaccatgttggccaggctggtctcgaaccctggcctcaggtgatccacccaccttggcctcccaaaacgctggaattccaggcgtgaccactccgcccagcggataacctgtatattgttgattcattaaccttgaacccacagcaacagcactagaactcatgcctaaggagcttctctaatgcatggactttttgtttttatcgagacagggtctcccaaagtctgatattgaaaagtggtcctggacaggcgaggtggctccgcctgtaatcctatcactttgggaggctgaggcgggcagatcacctgaggtcaggggtcgagaccagcctggccaacgtggtgaaaccccatctctactaaaaatacaaaattagccgacatggtggcacatgcctgtaatcccagctactggggaggctgaggcaggagaatcactgaacccaagagatgggggttgcagtgagctgagatcgcaccactgtactccagcctggtgacagtgagactccatctaaaaaaaaaaaaaaaaggaaagtggtccttagcgttcactatagacgttgccaatcagtcccacatcatatcacaagtactgggaactgaaatttgaagccgcaaggaaatgaacatttacgactcctggaaaatagcacttccttatgcaagcatcctgccatctgatgatgttttgacacatgaattcacttttcctccttcccaagtgcctcagcaccagtcctctccattcttccaagtagtgtctgtgtctgatgtgagcagggcacagcccaactctttgtaccatgggcaaggcagtaacttctcttttgagagaattgttcaagagaacaaagaagtctccctggggcctgaacactgagttcaagataagaaatgtttataactcgtgctggcagccaagagctggatcccagttgcagatggggctatgcgtagcagtgagaggggagacacagagacagggactgagagagagagagagagagatgggatcagggataaggcagtactgccaggcactgggctgggtgctttctgttcatcacatttaacttcacaatgccctcacacaactgttttctcccccatggtacagatataaaaagtgaagctctgagagataaatgatgcttgcgagtcttgtgcactggctgtctgatgccaaagcttgcagtctcaacatgatatcatgtgcctgtcccactggaggctggatggggggctgagagagctggaccataaacccttgcccagctgggtcctctctttgtctctggaaagtggggagggcccccagctctgtctacatgcagtgacgaagagggggtgagtcctcagccctgctcctgtcctgcccaatctgggtcacactggggatgacagatgtccagtgtggctggccaagaatgaatgccggggacaggaagagaatatgaatgcctgtggctggtggcagggtgactcatctcgggccttggtcacagcctcaaattcctgtgccagagcctggccctcctgtcattagtcctaagactgtcatgcaatgcaggagggatggatgggtacaggaggctagaggttctgaccccagctgcccctccagaagcctcagttccgccgcagccctgagcgtgaggtgggggtggagggcagtagggcaggactgtaggtaatgcccctctccagcaaagccaacacgtcaggaatagatggaccccctgtctgcttctcagctctcctgaccttccccgggacttaggacctgaccctgcttgctctgggcctccatctacaaagtgtctatgtgatgaggcagtcagcccaggtattactaaggcctgaagctcccatgccctgggattcctgcccagagaaaggaggcagccctgtcccagctcccctacccctccaggcaaggcaaaagcaaggactgcagcagaatggggaactcagttgaacatgaaccacccaaccaatccaggtgcttctcaggtgacatttggaatctgacagcaatgtcacctgttttacaacaccaccagtcattctgcagttgaggacactgaccacaaagagggcagaggcctgaccccaaagctcacatactctgcattcctccaggtctacggagaagggggagggcttcctggtccactccagctgggggcgctatggcccggcagacagggtcctccagtgaggagctctggaccaaggtctaacttggctccatgtactgctgtggcttgctccacccagtgccaggggtaggtcaaggtcaaggggcctcttaggcatctccaagggcatgctactatccaaatgtttgtgtccccactaaaggtcatctgttgaaatcctcaccttaaggtgatgatctttggaggcgggggcctttggaaggtgatttgatgagagggggcacccttatgaatgggattggtgcccttatcaaagaggcccagaggtgaggatgtggaagatggcaccttctacgagccatacctctcaccagggaccaaatctgctggtatcttgacttgggctttccagcctccagaactgtgagacagagaaataagccaggcgaagtggctacccctgtaatcccagcattttgggaggctgaggtgggtgatgacttgaggtcaggagtctagactagcctggccaacatggtgaaaccccatctctactaaaaatacaaaaaattagcaggcatggtggcgcatgcttgtaatcccagctactcgtgaggctgaggcaggagaatccttgaacccgggaggaagaggctgcagtgggccaagatcgtgccattgcactccagcctgggggaaaaagatagaaataaatctcttgtttgtaagcccctccgctttaaggtgttttttttcgcacctgaacggactaagggactaagggaccaggaatcatccaggcctcagcttccaaagcactccccactccccagttcctacagggccccgaccccagccccagcacccgtattcacattttttacttacaaaggaaactttgaaatggacacttcctgttactttcattaatgaaaaaaatccccagcacttgaaggcaatcatacagaaagcctgcaacaacgcagaagtagactcttcaggtggtggtgcctgctttaggctggctctccccgggtcaaaagggagtgataaagtgttaaagtgatgttaaggatcaagtgggcaccaactgcgactcccctccaccccccgacttaacagatgtcaaggaaaacagaaggaagccgtttctctccaggacatcagtgtctgctggagttttggaaaaatgctttctctcgagtcgctgcggggagctcccagctggacccccccgcacaggtcctccgccatcgccctcccagcccccgcccccaatcccctcccagacccggtccccgcccccatcccccgccagacgtcgtccccacccccatcccctccaagccccgcccgggagggcgtcctgcccgctcattgggcctcccgccggctcatttcatggtccgaggggggcggggctgacgtcgcgctgggaatgccctggccgagacactgagcagggtagagagcgcttgcgggcgccgggcggagctgctgcggatcaggacccgagccattcccgatcccgacccagatcctaacccgcgcccccgccccgccgccgccgccatgtagacgcagagcgcggctggagcttgtccttcgcgggctgcggcttcctgggcttctaccagtcggggcgacccgctgcctgagcgagcacgccccgcacctcctccgcgacgcgcgcatttgttcggcgcttcggccggggcgttgcactgcgtcggcgtcctctccggtatcccgctggtgcgtctggggacgctgcccgggctccacgtgcggagtgggtgccccctaggccgggagcgggggatccccaggggtcgcggggccctggaggagcgggcatcggacgcggacacgcggggtgcatcccgagggccccctccgaggcagatgcttcctgcgggggcgctgttcctggcccgggaagggggcgttggaaccccgagcggtccgggccgaagcctgggactctcgtcgtccccacccctacccccatcaggcgcccgtgcatgaagggagaccctcacctccggatgagagtcggagcgtctcggagcgacggggagtagggagcgggacccggggcggagggtgtgctggcccctgcggactccgggtcccctgtgtcctctcgggaggggctggacgggctagctgccgaggggccgatttgccctgggccggacaaagagtggggctttggccggtccccacggtgggctccttccctctggggattgagggactcaagacaccccgcgcctgcgctttcttttctttttttctttttttttttttgagacggagtttcgctcagtcgcccaggctgagtgcagtggcgtgatctcaactcactgcaagctccacctcccaggttcacgccattctctgcctcagcctcccgagtagctgggactacaggcgccagccaccaagcccggctaatttttgtattttttagtagagacggggtttcaccgtgttagccaggatggtctcgatctccgacctcgtgatctgcccacctcggcctcccagaatgctggggttacaggcgtgagccacgctccctgctgcctacgctctctgggtcgcagcccagccttctgggggctgggtagcctccagaagggcaaccctgggcatcctccagggcaggctaactggagtctagtggggagggtaccttgaaagaggaaagttgtttcctcctcctcctcctcctccagtgtttgggaccctcctgggggctggagtgcatccctggacaccccccaatcccatcctcttctctagtttccctgacctaggcccaccctcccctctccggctcagtactcctggaaatgagattccgtactttgaatcttgtcctaatgaaatatttgtccatgtgggtacctgtgtgtgtgtggtggggtgcagacggagggtttgtttctcactagctggaactactggggtgtggtatgcttcctggaatttgtgtgccacagtcctggaggcgaggagggggttgtgagccagtaggcaggggtggggcaagtagcattgtgaagctattgacacccagacgtccccaggcaggagattatgccccattagcccccttttatctgggcttccttaacaatggactctttgccctgcctgccgagccagcagggagtgactgttcagtggtgaggaagcgggcagaggaagccctgccattggtaggagcagtgggcagcccctgggctgactgggaggtggggattagggattagacagcctggctgtctgccttcccctaagccagggggagaggagcaaagggcacgaaatgtggctccaggaggattagaccgccacatgatcatttgcacaccctggggtttagcaacaataaagtcagcttttttgtatcccaaggtggcctgtggacacccacatggacaaatgtttacatgggacagaattcaaatgcagaggtcccaggagcctaaagtacactcactctggtatagaaggattccttactgggcagaggacaggtgcagcctggggctttcccaggcaggacacaggaggctcaggaaccaccaagtccctggaaggtggatctggaggcgttggcaggagccatccctgggttccagggctccaggttcctgctttaaccccctgtctcacagagggctgtgacttgggggctgctgagcatgtcccagaggctgcatcctggacacagcacctcagtgcactgagctgaggctaacttggcaggagggacaggcagaacctgccagccacgtgcaattcacccctctggccactcagggaaggagagctgtgagtcaagatcagatttgggtcaggacggctggggcctgcctgtccctgtgcatcccaagatttatggctggccaggggttgggctggaggggtggtcttgcatgccaggagagtgcagatcagcctgagaggccaggccagtaatgaggtcagatctcctgcacctgatagcattaaggccatctacaccaaagctctaatgcgatatgttcctggcctctatgtggggcatggaggtggggcatggaggtgaggcctgctccctgggcttctggaagtgggagactcattcctgtggctgaggcctacagcagtgctgtgggtaggaatacactggaagccatgatgtcattgtgcattttctagaagccacattgaataagtaaaagacacaggtagaattaatttcattgagcccaatatatccaaaataatatcatttcacatctattcaatataaaaatttactaatgagatatttcatactaagccactgaatccagtttgtatcttacacatctcagttttgacgagccacatttcaagggcgtgatagcacatgtggctcccatagtagacagtactggtctagagaaatgttggtggcatccttgcttctggtttctggccttgccaaaagtattaccatcccagtgtggtacattctttcatgtattgtctcctgtccccagagcagactctgcaggtcctctcagatcttgtgcggaaggccagagtcggaacattggcatcttccatccatccttcaacttaagcaagttcctccgacaggtctctgcaaatgcctcccggccaatgtccaccagctcatctccggcaaaataggcatcttcttaccagagtgtctgatggggaaaacgttctggtgtctgactttcggtccaaagacgagtcgtggatgtaagcagtttgcttatctggacgttgtcaagttagaaaagctgttttggatgggtgtggtggctcatgcctgtcatcccggcactttgggaggccgaagcgggtgggtgcttgagcccaggagctcgagaccaacatgatgaaacccagtctctacaaaaattacaagaaattagctaggcatggtgttgtgggcccatagtcccagctactagggaggctgaggaggagaattgcttgagcctgggaggtggaggttgcagtaagtcatgatcatgccactgtctccagcccgggtgacagtgagatgctgtctggaaaaaaaaaaaaaagaaagactgtttgttttggaagcaacacaggcagttgtaggccccctgtgccagagtgacataaactctgtcacctccagtgatttggtccatgtttgtaaaccctgaatgttccagggcagtttcttttttcactttttatctcttttttttgggtgggggggcggggtacagagtcttgctctgtctccaggctggagtgcagtggcgcaatctcaacctcccgaggagctgggactacaggcacagccatcacaccttgctaatgtttgtactttttgtagagacggggttttgccctgttgccaggctggtcccaaactcctgcacccaagtaatctgcccacctctgcctggcagttacaattcaaataattcctccctttccttcaacacttggctcatgaccgtccagtccaaggaactgtcctgcaggtgtgcctctcccgagcttcctctatgcatcttccataatgaagatgcctctcactggaaaccctacaagggtgggaacgtgccttatttgcctgtatcctcagggtcagcagagagaagataatctgtaataccaaaacaccattaaattcagctgatgctttcatagcgctccttggaggaaggactccatttacttgacagatctgtgcaagacagcagcctgcgcgtctaacctgcagccagttgcatcctctgtttaaccttgtttgcggaagctttctcaaacagccagcacttgtctgttcccacatgggtccgttctcccagtgaatcaccgtggtcctgctgactgctctgtagcacagtgcttcgcaaagtgtgatcctgggaccagcagagcgcagctcctttgagcttattggaatggcagaccctcaggtcccacctctgacctgctgctgggaattctggggagggacgcagaatctctggttccacaggctctccggtgatgctaagaataccggcatttgaacagcaccgatctagcccctttcagtccatgagccaacaaccctggtcctgtctgtggtgacccagtgtgactctcatggggagcaaggagaggaagttgaattcactgacagggttgttaaggggattatgcaatagatgagacccatgggcctgaagtcgagggtgtatgttagttccccgttcttttgacccatggattaacctactctgtgcaaaggcattttcaagtttgttgccctgctcacttggagaaagcttatgaaggatcaggaaaataaaagggtgctctcgcctataacttctctctcctttgctttcacaggccttggtatgttctgcttcatccccttctacagtggccttatccctccttccttcagaggcgtggtaagtcgctttctctgctagcgctgagtcctgggggcctctgaagtgtgctcacacatctcctgctgcagggcactggtgtcgggcacctcagggtctgtcccatggtggagccccatgcctcatgcctttcagacagagtagccacagctggccctatttccaggctacccgggcagcaaaattactgcatgtgtaattaattatttggctatctgtaaggtaaactggctggttcacttatctgcaccttaagcatcagatagcttctcagtgatctagttaaactatatgatgttggcaggcgcggtggctcatgtctgtaatcccagcactttgggagcctgaagcaggcagatcattgaggtcaggagttcgagaccagcctggccaacagtgtgaaactctgtctctcctaaaatannnnnnnnnnnnnnnnnnnngtgtaaaagtgttcctatttctccgcatcctctccacacctgttgtttcctgactttttaatgattgccattctaactggtgtgagatgatatctatagtggttttgatttgcatttctctgatggccagtgatgatgagcatttcttcatgtgtttttggctgcataaatgtcttcttttgagaagtgtctgttcatgtccttcgcccacttttgatggggttgtttgtttttttcttgtaaatttgtttgagttcattgtagattctggaattagccctttgtcagatgagtaggttgcaaaaattttctcccatgttgtaggttgcctttcactctgatggtagtttcttttgctgtgcagaagctctttagtttaattagatcccattgtcaattttgtcttttgttgccattgcttttggtgttttggacatgaagtccttgcaagggcattttcaagtttgttgccctgctcacttggagaaagcttatgaaggatcaggaaattaaaagggtgctctcgcctgtaacttctctctcctttgctttcacaggccttggtatttcctgcttcatccccttctacagtggccttatccctccttccttcagaggcgtggtaatcggctttctctgctagcgctgagtcctgggggcctctgaagtgtgctcacacatctccgcctgcagggcactggtgtcgggcacctcagggtctgtcccatggtggagccccatgcccactgcctttcagacagagtagccacagctggccctatttccaggctacccgggcagcaaacttactgcatgtgtaattaattatttggctatctgtaaggtaaactggctggttcactaatctgcaccttaagcatcagatagcttctcagtgatctagttaaactatatgatgttgccaggcgcggtggctcatgtctgtaatcccagcactttgggagcctgaagcaggcagacacttgaggtcaggagttcgagaccagcctggccaacagtgtgaaactctgtctctcctaaaatacaaaaattagctgggcatggtggtgtgcacctgtaatcccagctgctcgggagctgaggcaggagaattgcttgaacttgggaggcggaagttgcagtgagccaagatcgcacactgcactccatcctgggtgacagagcgagactctatctcaaaaagaaaaaaaaaaaaaggtaaataaagtatatgacactgaagaatctgttacccctggaaggtggagctttactttagggggaactataacagtcatatatatatatttttttcttttcttttttttttttttagatggagtctggctctgtcgcccaggctggagtgcagtggtgcaatctcggctcactgaacctccacttcacaggttcaggcaattctcctgcctcaacctcccgagtagctgggatacaggtgcctgccgttacgccaagctaatttttgtatttttagtagagacagggtttcacatattggccaggctggtctccaactcctgacctcaggtgatccgcccgccttggcctccaaagtgctgagattacaggcgtgagccatggtgcccggccaacaatcacatgtgttgtaacaacaacaaaaatctgtcagcctggtctaacctagatttgtgctttgttttgttttgcactttgtgatgcacaggaggaagtttaggctgtaaaatactagccttttagggtaattttgaactcacaagagcagcagcggaacctttgatgcaatcctgtatgtagcaccagcaggccacgtggcagagggactcgcattaggagcctcccattacagactacgtgctcctgtggttatcttatagggtccccacaaccaaggggagatgtgattattcatcctgtgtggctgggggaacttgagagtcatacttgcccaaagagcacggccagcgagcttgcacccaggtcctctctgctcctctgtcagaacagggcatgtcttggttcactgcagggcggctcttctcttctctgtagtttggggtccaggatagtggtccacggagccactggagtgcccagctacgagtgaccaaagcatattttggatttccgacattgccacagcatggttgggcatcagcagaccccaaccccttgttatgctggtggctttatgtggttatttgatcttccccagaactagcaggagtgcacccagcagcaccgtagtgatgctctctggctccccagtgcacggttcggctttccttcctggtcgagagtttcaagccctctgggtcctactctgtccttttcagccatagctttgttcaaaagctgctggcagtgttcagatttggctgagttcagtgaatatggcattggctgatttctgagccatgccagggggatggagaagccgaagcaggagtgtttgtctgcaggctctggagtaggcattgggtctgtgccggctcacttgctagtcttgcatcctccctaaccccctctggggatgtctggccacatcagaagacagtttgggttgtcagaacgggggagtaccaggccgaggtgggtggatcatgaggtcaggagatcgagaccatcctggtaacacagtgaaacctcatctctactaaacatacgaaaaaaattagctgggcgtggtgggggcgcctgtagtcccagctactcgggaggctgaggcaggagaatggtgtgaacccgggggcggagcttgcagtgagctgagatcctgccactgcactccagcctgggcaacaaagcggactccgtctcacaaaaaaaacaaaacaaaacaaaacaaaatctgggggagtgccactgcatctgatgtatagaggcccgagatgctgtgtcatcacccgttgagtgcgctcataggctcttcctgacaattagaacccattattcttcaaattcaatgcaagcaaattcaaagcatactgtgtacataccgcatgctaatcaattgcaccactggagctcctaaattcaaaacatactataaaaaagttcaaaatgcatggaaaagttgtacatggcaggagaatatttgggctctgactaccccttgaatgaagatgatccaccagccgccttcctccttggtcttcactccgattcctagcatttcattctgtgtctctttatgcagtgaggtttttgtttgttttttgaacagagtctcactgtatcacctaggcctggagtgcagtggcgcgatctcagctcactgcaccctcggctcctgggtttaagcgattctcctgcctcagcctcccgagcagctgagattcaagcacacatccccatgcccagctaatttttgtatttttagcagagacagggtttcacatgttgcccaggctggtctcgaactcctggcctcaagtgatccatgtgcctcagccttcaaagtgctgggattacaggcgtgagccaccatgcccagctcctagtgaggtttttgatgcttgctacatctgccctagaaattgtgtgactacgattttggaaatgttgctgtgtaaattgtgatcatttctggactccaggcaagaatcttgatggctaaggtgtggctgaacatgctgattctctcctggacctgttttaggccaaactctgctctgaaattcctccgtgtggagggcgggctggggagagcctcccagctggaatcttttggatgcctttctctgtgggtattgatggctggctctgatggctggctctgatggctgtggctggaaatcattgttgacatggtttcacagatgcaggctctgtccaaattgtagcaaaagctgcctgccccagccgagcttgggcaataaggtggtttaaggatatagatgaaggaaaactcacccttagaataatttaccaaaatgctgctgtgttgtgggttagaggacattttctgaggtcccaggttcattgttcatttaagtctcaaaagtccctccaggtgttggttctaattgtcaaagcatggggggagtgggctcatgggttaaaggtcttatcccagatttctgtatcctccttgcaagcagcaaagggtctggatttgaatccatgaccatgtttctcctttgggtttccatcacactctgtcccgtgcactgagcaccctttagttcatatgacccccttaggcatgttacatgggcactccataggtgcccatctggccctaggacttggccaacacaacatggactccagtttccatctcctctttgccaggcacttttgtgcagtgcacacactgtacaacagtagacggcaaccctagagccagagtagagcctgtcctagcaccggaatgctcggtaaggatttgtcgcaggaggattccaaagccaatgtcctccctccatatcagcctgtttgtggctctgagaagctctgccacatgtgaaagcttgttaagcacttaagcactaacccagagcttcagacagtgccagcctttttccccttctttaaaagcgatatgtggatggaggagtgagtgacaacgtaccctcattgatgccaaaacaaccatcaccgtgtcccccttctatggggagtacgacatctgcctaaagtcaagtccacgaactttcttcatgtggacatcaccaagctcagtctacgcctctcacagggaacctctaccttctctcgagagcttttgtccccccggatctcaaggtgagttgtggtgagggggcaggtgttctggggtgcagctcttctttgcctccctgattgccaggactaccagttactgtctgcacaatcaaacagaaatagacctgtccttgatggttaacggaataaaaggcgcttgtcccagaagctcaggtgaggcaccaccctgattatgggaatcaccgggaacatatacccagacctaaaactcagatccacttcccaggctgtggttatatagtcggggggtgcagtatgggtattaggattttttattttttagttataaagatttttttttgtttgtttttgagacagggtcttgctctgccgcttaggctggagtgcagtggtgcaatcaagctcactgaagcctcagactcctgggttcaagcagtcctcccacctcagcctcctaagagctgggacccacaggcatgcagcaccacacctggctaatttttaaaaattttgtggaggttgcccaggctggtctcacactcctggcctcaagcgatcctcccaccccagcctcccatgtgttgggattacaggcatgagccattgtacccagccactaagatgattcttatttggaacacggtcaagaacaactgcgttcggtagtttaaccttttttgattgtggtggttttatatgccttaccactctaccatagtaagaaatttgcagaccatgtacaccaacctttggtctcctggggagaaagaaagaaggctatgcaatgcaatgcatgctcacagtccaagggaggggaaagctgtctaacaggattggttttcccgtgtgctttataagcagatgagtagagggacagctcttattgtcctagtggcaattgggataggctgcaaagtttgttagggtggagcttattccgggaccaagggagcccaaagaaacaagctcctgccaggcgcggtggctcaccctgtaatcccagcactttgggaggctgaggcaggtggatcacctgaggtcaggagtttagaccagcctggccaacatggtgaaaccccgtctccatgaaaaatacaaaaattacccggcatggtggcgggcacctgtaatcccagctactagggaggctgaggcaggaaaatggctgaacctcggaagcggaggtggccgttagccgagatcacgccactgcactccagcctgggaacagagcaagactctgccttaaaaaaaaaaaaaagaaagaaaagtaaaaggaaaaaaagaggctctggcctgctggggtgcctgcaaagtctccgtggaagggtgacattcaagccggacctccagggaactgtctcctgggagcacagagccctttgctcagcccccaggtggctagtgcccccagccagcagactcagagcttgcatgattctttggtgctctctgcggtcttcaatgatgctgaaataaatggtgcttggtgtctccctgctgtagtccccttgcttgcttgctcacaggtgctgggagagatatgccttcgaggatatttggatgcattcaggttcttgaagagaagggtatgtatgggctgggaggatcagccatgcccttttgacaagcatttactgcggtcttggtaaagacttgagatttgccttagttctaacacttagtgcccaacgccttcttgtgttgctcaacctactcatgagcccaggagataggaaatctccgtcccattgtacgatggggaaacagaattttggaaaggagagccaagcagcacacacccctccctgaggggagagccgagatttgaactgggatgtcatgactccagggccctctccctccccagggtcccttatctgaaggcggtttttctttccagctcgacctcttgtgacccttagtttaacaaggccgaagttaaagagtttctgcgcctggaccccaaatgaagcaatcagatttctcatctcagtcaggtgtgggtccaagcccactagacaagtttgctcttcccagagcacatttctgcttcaagtcatcctggcttgtcagggctgggggagttctgctctagaaatattagagtgaaggaaaaagatgtgttgggagctatttttctttaatactaaaagttggttgatgaattgtcgttggccaagaccaaggagactgcatttttaaggacatatgtgtatttatctgctcgaaaatgttcattgctgtgtgctagggatactgcagtgaacacagaggtgtgacccttgcagccttgtgagagaagtgagcagataagtaagcagaagggtgatgctgtgtcgatgggaagtacaggtgccaatgagaaggcacaggtgtcaaggagaagacacaggatgctggaggtcatgcaggatggatctccaaggcccaggggaagaagggcctctcggaggacgtgaatcacattaagactttggggataagtaggagcgccttaggcatggggacccatggatgcgagcctgtaggacacagagaggatggcatgaaggcctgtgcaactggaggggtggggatgggacactaagagatggctggaagtgtgggggtggggacactaagagatgactggagaagaggggtcaggagtggtgaaaaatgggagaggagggcaggctgggccttttggatacaggggattgcatcctgcagtggtagggagccactgagggctgctgcagtaggagtgaggggatcgaggagagctttggaagccccctggatgcgggacaggaagggagataccagtgtctaggggccagtgaggcagccagaggctccaccaggatcagggctgcgagggtcatgaggaggaaccaatttgaaggagtccaggggaataggacttggaaatgaccgatgggacatttgggagaggaagacagaagagcgcagtcccagcttctggctttagcagttgggcaaggggagatgggagatgtgcccatgggttgagggttgaggacattaggagggagccggtatggcaggagagctggtgtgccagagatgctggaagcagcatctgcctgagaacagatacctggcaatttcctaagggaaagtgacatctcggagggtgaggagggcatctgatagggcctggaaaggccggggcaagcatgaatgtgaggttatcttggggggcaaggctcaggcgttgaggagcgcccctggtctcttcagcctgaagttggaagccagagttgggccaggtgcagctgtggtgtctgaagtccccctcccccagcccagtgtgccaatgctgtaagagcaagggccgctcatggtgctggtggctgagtcccagcacccaggacagggcctggcacatactggtgcccaacctcccttctgggtgcttcttccaaggccttgtgatggaagtgagtaccctcttcgacacagacccagcttcaaatcctggctctgctatgtattggctgcgtggctttagacaagtctttaaccttgctgtgcttctgatttctcagctgaaaaatggagatgatgatagtggttttgtaaggccttatggtgaagcacctagctcagggcctggaaggcaggtgtaaccagtggtcagttgttataaaccaacactaaccctcgcctttgcacctcatgaatccagatatgtaatggagcccacaaagctagcaggagccaagctcacgtgtgtcctgctttaaagccccatcccctttctccgggtgacaaacacctgtgctcgttctcttcccttcccctcttccccttcatttggctaataacaggccagctgcctgcctccctgcagtttggtagatgggtgggtacgaccaccactcccacgttcgcctgatgggcttgttttccgtgcccttcacaggcatctcaacaggccccagccaggcctgaagtcatcctcagaagggatggatcctgaggtcgccagcccagctgggcaaacatgagtctggattcttccccggagtcggctgccttggctgtgagctggagggagatgagctgctagaccacctgcgtctcagcatcctgccctgggatgagacatcctggacaccctctcgcccaggctcgctacaggtacccactcctcggggtgagcacggcagcaccttgttttctttcttgtgcattatggaggaagatggtactgccacatgggacgatagggtgaggcaaccatgacaggtggttgggaacatctccttccatgtgtacagccgggctgctgccatcactcccagcacagcccccaacccccccaatcctggaaccttgccagtctcccttcccatggggtcatgaccaggaggaaaacaaactccagctgagccccttgggttccccatataggctcctgcctgtggcagctgggccctctgtacccctttccaactcttctccctaacatggcacctgagctcctgccatcctggatttcatggaccccaaggatggggtcctgcatctgggacttggcctattactcggagctccttttcagccgcctccctccactgtccacccacctcaaggctcctttcttgagacctctcctaatttctcccttcccctaacccacaattttgaacctccatcgaatggtgctgtattttataatgtcatcaaatatcaatggagacagtgctatggtccaaatgattgtgtaccccccagaatttgtcttttgaaatctaacccccaacatgatggtcttaggaggtggggcctttgggaggagattaggtcatgagaaagggctgtcatgaatgggattggtgcccttattaaacagacccaagagaggtccctgtcccttctactgtgtgaggactcagaaggtggtgtctatgaagaagcaggccctcaccgacaccaacatgtctgctgccccttgatctgggaccttgcagcctctagaactctgaaaatcgatgtttgttgttttataagccactcagttggtggcattttgttagagtagcctgacacggactaagtcaaacagaagaacccacaaaccagctacagagttgggcatttggagaattcaaaaatgagtcagacataactccttattcttgaggtgccctaagagatgggacacgcagctgcccaggtgcattagtttgttctcacattgctataaagaaatacctgagactggtaactcataaagaaagaggttgaattggctcacagttgcacaggctggacaggaagcaggtgctggcatctgctcagcttctggggaggcctcaggaaacttacaatcatggcagaagtgaacgggaagcatgcacatcccatgactggagcaggagtgagagagagagggaaataagggaaggtgccatacacttttaaacaaccagatctcatgagaacacattcactatcaaagaacagcaccagtggggaaatccgcccccatgatccaatcacctcccatcaggctccgctccaacactgggaattacaatttgacatgagatgtgggcagggacacagatccaaacctatgaccagattaatacgatttgaggcatcacgaggtcattaaagagagggaataaaagctggggctccaggaagaaggctctggaatccagcagagggtcaaggaccagcttgtaaactggtggtgcctgagaagtacctaggagaacatagatgctgtgacgtttgatgtagctgtttttgttttgtgttttggtttttgagacagagtctcactctgttgcccaggctggagttgcagtggcgtgatcttggctcactggagcctccatctcccaggttcaaatgatcctcagcctcagcctcctgagttgctgggattacaggtgcacaccaccacgcctggctaattttgtgttttcagtagagacagggtttcaccatgttggccaggctggtcttgaactcctgactcaagtgatccaacaacttcagcctcccaaagtgctgggatgacaggcatgagccaccagcccagcctgatgtagctgtttctgtgcacattatttgctgtggggtatattcagatttttaatacaagatgattctttgcctcatgacttacacaccattttctatttaatttcagcatgatattggaaatggacatgtcttttcaaggaaaataaaagcaggctttctggaatgggacttccaaacatatttgtcaatttaaaggagctgggagtggggaccctatgctccgtagcactctcttagctgttcttggctgtgctccccgcttcagcttcacactgcccttgctggaagggagcagcctgggccgggcgcggtggcttacacctgtaatcctagcactttgggagccgaggtgggtggatcacctgaggtcaggagttcaagaccagcctggccaacatggtgaactccatctctactaaaaatacaaaaaattagctgggcatggtggcaggtgcctgtaacccagctacttgggaggctgaggcagaagaatcgcttgaacccaggaggcggaggttgcgtgagccgagattgcgccattgcactccagcctgggggcaacaagagcaaaactctgtcggaaaaaaaagaaaggagcagcttggcaaaccccaccttgtcgcttttgtgagtgcctcgaccctttggctgccaggacgggcgtattttatggaaatgctaagcaccaacagagtaagtggtttggtttttcacagtggtgggagataatagctccaaattgtctttttcagcactagtgaagaaatgaaagacaaaggtggatacatgagcaagatttgcaacttgctacccataggataatgtcttatgtaatgctgccctgtaccctgcctgtggaatctgccattgcgatgtccagaggtgagcattttaggtggctccgtgtcttcctcacagggttgatatgaggataaacaagatgatagatcatggtggcatgtagtctgggacctggattgtcgtgccacagacacagctcacagtctatgtgcaatgcccctgaatgttgcccacctgtcctcaagccacaatgcacctgtaactcagtgcaagcccagaaactccccgtggggactcctagagctgtcatggcctcacatagcagctggtccagtctcttgtgattgcccaaggaaactgaggcctgggagcttggggtcgctgctctgaggccatagagatgcctagtagaagggccaggcctagagcaggatccttgctgcccctctgagctgtttccatttaaaatcacatgaaggccggcgcgtggctcacggctgtaatcccagcattttgggaggccaaggtgggtggatcatgtgaggcaggagtttgagaccagcttggccaacatggtgaaatgccatctgtactaaaaatacaaaattagtggagcatggtggcacgtgcctgtactcccagctacttggaaggctggggcagagaatcgcttgagcctgggaggcagaggttgtagtgagccaagattgtaccactgcactcagcctgggtgacaggagagaaaccctatctcaaaataaaatgaaaggtaatgaaatgataaaataataaatcaagtcacggccgggcacggtggctcacacctgtaatcccagcgcttgggaggccgaggtgggtggataatgaggtcaggagttcaagaccagcctggccaacatgtgaaaccatgtctctactaaaaatacaaaaattagctgggcatggtggtgcatgcctgaatcccagctactccggaggctaaggcaggagaattgattgaagcaggacctaggaggcgaggttggttgcagtgagccgagatcatgccactgcactctagcctgggctacagagcgaactccgactcaaaaaaaaaaaaaaaaaaaaatcaaatcacatgaaagtagaacataggaattccatctttcgttctaggcatagtttgttaatatgattcagagccagcagttaggaaacacagtgtgactctcctagaacttcttgattgggcttcctctgattgggtttcctctattgggcttcctctgaaagtgggggggatggggggtggggagcagaatggtcagagcttgctcagcagtcagactgctcttcttcaaatcctggctgcattgcttactacagctgtgtactccagatgactgaatccacctctctgtgctgcagcttcccgtctagagagatcacctgagcagagggtggtcaggagactcaatctggttactgactcacagtgcaggagtactcacccatagtaagcatccagctagagatgttgatttctattttcaggtaataatgatgatctaaaattagagacagataaaaggtatgggcattaggccagggcactgcaatttctaagcgtgtgacctcaggcaagttactcgacttctctgagcctcagcggtttcatccgcaatattggataggaaaaccgacctcagtgggttgtctgacagtggagggcacttgattaaaaaaaaaaaattaccctggtctgaatattaccctggactgaaagaaaaatattgagctaatacggcatcaggaatggggctgcagggagtccagggaagggagaacgaagagcctgaaggtggaggaggtgcgagtgctgatctgtctgctacaaagaggctgctgagcctcctgtggatgggccctggacttggcagtttaatacctgagctgttaaaataacctcagatgctgtgttcttaaggggtaggattcagattcctgctgaaatgcttctgaaagggagggaatgagccagccatccccagttgctttttaagatcattgggaagttctggtcttgccatttgtccctggccactcttaggtcctcctgccccacttccatctgggtgtgtgccctgggctgtccaccaacagctacatcctgccatcttccctcctggagccactgtgccatgcatggatctgtagctcatttttcttggcttttccctggtttttctggagcagagtctctagtaaactcccaagaagaaaacgtttgactttatgtgtgttgggaaacgtgctttttttctattacatctcaggataggttggccatgtctagaattgcaggttgaaaatcatttcctctcagtatattggtagtgagaagcctgggactgagacagtcacattctcacttctttgcaggtgagtgctcttggactgtctttttatcccttatactctgaaatgtcatatgtcttggtgtaagtccttattcagttattgagctggacaagtactggagaccccttcagtcaaagccttctgtcattctcagctctaggaaattatcttctattgttatttctgttattccttcccttccattttctttttctttttttttttttttttttgagacagggtcttactctggtgcccaggctggaatgagtgacctgatcatggtacactgcagcctgaacctcccagactcaagtgatcctcccactcaacctcctaagtagctgggactgcaagcacacatcaccacacccaacaaatatttttaaaaattttgtaagatgggatcttactatgttgcccagactttttcttcctcttcctgggctcttattaggaagatgtttgacttcctgggttggattcctgtctccgtgtctgacttctctctttgtcatatttttcatcactcgttgtctttttgcgtctgctctgacagatttctcaaattttgtcttctagtcctatcctacagtttttactttcagcaaatataatttaattccaagagtactctcttgttcttttttcttagcattctgttcttgttttatggatgtaaattctcttggaatatttgctgtcctctagatcatcccttctccatttcttcttgggctatttttctgtttcttcatctttctcttttatgctacttattctgggcgtgttcttggtggttttttcccatatagcaacagaggacttggagctcagggagaaaagggtaggtgcatcactggcagagctcccagacagtgacaggcaggctgcgggaaggatgtctacttggcggtgtaccgctttcctagaaaccctttccctggagctggttgaactgttgggttttgccctggggtgaacgctggctccccgtgctctgcctgtttcatcaccagccccctccccttctgccggggtccagtaatctgttgaaatatatatcttgctcattggtgagctcctgctccttcccgttgctcttgcagatttatcacttctcgtaaggctgcgcttgtacttcgggattttcttgtgccacactgggaaacatagggtggttgcatgctgcagtcctgagcacttatttcaccacatctttacacgaagatttggtgggtgtttactttgtttttagtaagttagtctgtctgtcctttgatcctttttttttgttttttgagatggagtctctctgtgtcctccaggctgagtgcaatgtcgcgatctcagctcactgcaacctccacctcctgggctcaagagattccctgcttcagtctcctgagtagctgggattacaggcatgtgccaccacacctggctaattttgtatttttagtagaggtggggtttggcatgttggccagcctggtctcaaactcctgcctcctgacctgcctgccttggcctcccaaagtgctgggattacaggtgtgagccaccaacctggccctgattaatcttttaatgcccagtctctccttcaaaagccggctcctttcttccctcgccttcctagattccttctccactccccaggatcagcctcctcctccccacccaccactgccggggggatgtctgtggtcaggcatttatcagagaccctgaggtgggggtctttatgtgtctgggggatggagagtctagaggaggtagcgttcagacctctccatggtgctctgctgggctcacatgtgaccaagcacagcaaaccatgaggcaggggatggtcttgacatgagagcccttgcagcagctgccatgggcctcagctcctctccaagctgggaagagcctgaaaagccaaggtgtttttttttccctctttatttcagtgtaagtcccttgagctttttgaaccagaagtgggctcattttgctttagagatttcaggtgggcttgtccttgtcctgcatcccagatccaccttctgggaagtcatcagattggaggtgatgttggcagcttttgaaacaaagggtagtgttgtaagctgttgtgtctgcctatgtgtgtgtttgtgtacttggctcatctctgcagactggtgacatggcttccagatatgcccgacgatgtcctgtggttgagtgggtgacctcacaggtgttcactcgagtgctgatgtgtctgctccccgcctccaggaaatactttggctgtgggtgtgtgggccggacgggcacctctctcatctgatgaggcctacacgacattctagaaacagctggctgaacaccaagcaaggagcttgcccttgggtgtgggaccctgtctcatgggaggcagctgagtcagtcagaggtcctggcacacctgctgagactgccacccaggccaacctgaaccggagcctgggaagacttcccgttggatgagtctcttgagggcagcattgatggtggaagagcagagaggccccagataagcagggaaaggtgctcagacagagtggctgggatgaggactggggagtgtcagatagcgctggcgtgtctgagcaaggagctctggcacccatggcacaggaaggaggtgggaccctggaggggcagggctagagagctcctcggagcgtgtggctaggtgcctggtaatgcaagccccctgtcctccacccctgttgtactgagtcacagtctccggggtgaagcctagcagtctgcgttgacaggccccggggatgccgctacttcctgaattctgaattctggaaactgagccggagttcagggcctgctcccattaccagggttgggcgttatcctgaaaatcataggccttggtttcctcacttgctaacaggggtgatccccatcccctcaatgggtttccgtgagctcctgagagcccgtacatggtacttggcacatgctgggcatcaggaggtatggcctctcttgctattgttgttatggtagacacagaaggatttaaaagtaggggaatgcaaagatccgatttgctagggaaggggcagtagtggccaagtagagggtggatcctgggccctggctggcagcaggcagcaagggggctgccagggcccaggcagggacgatctgtagaccgagaggcttcctaaggctcttgacaggaggaggtgtcggttccaagcctaaggagtggggcagccctggtgactggtggtagtggtgccaggcggtgggtggtaggacaccctggcaggcaagtaggtttgtgtgggggaactgataggcccctccagggattcgttggtggacaacacctgtgatgtccagtgggagtgtccaggtagctgggagggccacaggcttggaagacctaggtggtgacatcagcccagactgagggctagaagaagctgtgtctctggctgtgacggcaccctagagtgtgtgtggtccctctactggccggcaatgtgggtccaccgtagctcagactgcacactgcagcagcggaacggcctctaagccaacttcctccatgtgtttcaggtcccaaatgccagtgagcagccacaggcctccccatgcacacctgagcaggactggccctgctggactccctgctcccccggggctgtccagcagagaccaaagcagaggccaccccgcggtccatcctcaggtccagccgaacttcttcttgggcaataaagtacctgctggtgctgaggggctctccacctttcccatttttcactagagaagagtctgtgagtcacttgaggaggcgagtctagcagattctttcgaggtgctaaagtttcccatctttgtgcagctacctccgcattgctgtgtagtgaccccgcctgtgacgtggaggatcccagcctctgagctgagttggttttatgaaaagctaggaacaacctttcgcctgtgcagcggtccagcacttaactctaatacatcagcatgcgttaatcagctggttgggaaatgacaccaggaagcccagtgcagagggtcccttactgactgtttgtggccctattaatggtcagactgttccagcatgaggttcttagaatgacaggtgtttgatgggtgggggccttgtgatggggggtaggctggcccatgtgtgatcttgtggggtggaggaagagaatagcatgatcccacttccccatgctgtgggaaggggtgcagttcgtccccagaacgacactgcctgtcaggtggtctgcaaagatgataaccttgactactaaaaacgttccatggcgggggtaacaagatgataatctacttaattttagaacacctttttcacctactaaaataatgtttaaagagttttgtataaaaatgtaaggaagcgttgttacctgttgattttgtattatgtgaatcagtgagatgttagtagaataagccttaaaaaaaaaaaaaaacggttgggtgcagcggcacacggctgtaatcccagcactttgggaggccaaggttggcaatcacctgaggtcaggagttcaagaccagtctggccaacatagcaaaaccctgtctctataaaaatacaaaaattatctgggcatggtggtgcatgcctgtaatcccagctattcggaggctgaggcaggagaatcacttgaacccaggaggcggaggttgcggtgagctgagattgaccatttcattccagcctgggcaacatgagtgaaagtctgactcaaaaaaaaaaaatttaaaaacaaaataatctagtgtgcagggcattcacctcagccccccaggcaggagccaagacagcaggagcttccgcctcctctccactggagcacacaacttgaacctggcttatttttgcagggaccagccccacatggtcagtgagtttctccccatgtgtggcgatgagagagttagaaataaagacacaagacaaagagataaaagaaaagacagctgggcccgggggaccataccaccaatgcgcggagaccggtagtggccctgaatgtctggctgcgctgttatttatggatacaaagcaaaaggggcagggtaaagagtgtgactcatctccaatgataggtaaggcacgtgggtcacgtgtccactggacaggggtcccttccctgcctggcagctgaggcagaagagagaggagacaaagagaaagacagcttacgccattatttctgcatatcagagactttagtactttcaataatttactactgctatctagaaggcagagccaggtgtacaggatggacatgaaggtggactaggagcgtgaccactgaagcacagcatcacagggagacagttagcctccagataactgtgggcgagcctgactgatgccaggccctccacaagaggtggaagacagagtcttctctaaactcccccagggaaagggagactctctttcctcgtctgctaagtgcgggtgttgttccttgacactttttgctaccgctagaccacggtccgcctggcaatggcgtcttcccagatgttggtgtcaccgctagaccaaggagccctctgatggccctgtccagcataacagaaggctcgcactcctgtcttctggtcacttctcgctacgtcccctcagctctatctctgtatggcctggtttttcctaggttatgattgtagagtgaggattattataaattggaataaagagtaattgctacaaataatgattaatgatattcatatataatcatattaagatctatatctggtataactattcttgttttatattttattatactggaacagctctgtcctcagtctcttgcctcagcacctgggtggtttgccacccacaattttccacatgctctggtctgcgttctttttttctccttgcatcttctcattctctgatcaccccaacctcctctgtcttccctactctgccagccttgatggagacaagcccttgagaccagaactcacttttccccaggtgtgataatctattagcaaggtcagtgtaatatgactgacggtgaaactgtatttttttctatttatgcatttgagtacagtacgtacaagaaaaataatggtgtgccaaactgttaaatgttggaaaagaaagatacaacccttacccatattgtgtaagtgcccggagtagaagaaccagcaagctcagacaaagcacttgactgagaagacagaccctttaaggaaacgggttctagggacaaactctacgtgggcctgttctcttgataagaccgtgaacctttgagaaaagaggctacttgtgaaaataatgagcccccttcggggcaggagttccgggtttgaacctgccttcttacatcttgagggctaagtgagttcccaaggcctctgttcagggttgctccgtcagtgagctcaggtctggtgagtggcagggtcttccacccccaaccccccgggtgtcagagcaagacactgtcccccatggagctggaatggggtggaggagcccactctggcacccacgtggcctccttgtgacggacccacccttgcaatgttggaaaggaaagtacaagtttcttttcccaagtttcccagtaggctttgttctgttagcttcacgccttcgtcattagcagacataaataaactttaaccattgttttttatcttttttttttttttttggatggagtttcactcttgttgcccaggctggagtacaatggcacaatctcggctcaccaaacctccgcctcccgggttcaaacgtttctcctgcctcagcctcccaagtagatgccaacctcccaagtagatacaggcatgtgccaccacgcccagctaattttttgtatttttagtgagatggggtttctccaggttggtcaggctgatctcgaattcccgacctcagatgatcccccgcctcggtctcccaaagtgttgggattccaggtgtgagccaccacgcccggccaacgtattttctaataaccagtatatttccatatacatgtgtacatgggtattgtgattgtttcaggaaaaaatatattaaatggctgataggagaccatgggacgtattttctttctgctttaaaaattattcaggccgggtgcggtggctcatgcctgtaatcccagccctttgggagccaacgtggacagatcacctgaggtcaggagttcgggacaagcctggccaacatggtgaaccctgtctctactaaaaacacaaaaattagccaggtgtggtggcaggcgcctgtaatccaattagtgggttggctgaggcaggagaatcacttgaacccaggaggtggtggttgcaggagctgagatcgtgccactgcaccccagcccgggtgacagagtgagactccatctcaaaaaataaaaaataaaaaataaaaaataaattattcaatcttctttatttttattgttttatgactaaagttatttttagtagaaacagggtcttgctatgttacccacgctagtcttgactcattggcttaagcagtcttcctgccttagcctcccaaagtgctgggattacaggcatcctggctcctccaccttcttaaaataagcatttgttttataattttttccaagtgtgtacaagataaggaaatcaggaagtgtaatattcttatagaaatggccaaggcctcccccttacctgtgcctcagatgctacccaatcccgccttctctgtccctccagaaggcaccctttcttaggcctccctctcttcctgaaccacctctggaagtttcttattggcctatgaatgcttcttatttcttcttatcaaataaagccttccctttaatttatggcacatttatgctttgaatccactctcaggaataatcagtatgtagcatattacacgtcaggcggcaacattcttttttttttttttttttttgaggcagggtcccgctctgtcatccaggctagagtacggtgtgcaatcatagttcactgcagcctcaacttcctggggtcaagccatcttcccacctcatctcccaagtagctggaaccacatgtgtgcactaccacacccagctagtttttttttgtgagacagggccttgccttgttgcccaggctggtctccaagtcctgggctcaagtgatgccctgccttggccttccaaagtgctaggattacaggtgtgagctaccatgcctggtccaaattcttcatttggtaaatggctaaacttagtgcagagtatgagcctgattttgtttaaaaaaaaatgtgtgtgggtgtgtatatgtatctttgagtgtatataaaaagactgaaagaggctgggcacggtggctcatgcctgtaatcccagcactttgggaggctgagggaggcggacacttaagtcaggagtttgagaccagactgggtgaaaccccatctctactaaaaaatgcaaaattagctgggcatggtggcgggcacctgtaatcccagcaaccagggaggctgaggcggagaatcacttgaacccaggaggtggaggttgcagtgacccgagatgcagtgagactcacctcaaaaaaaaaaaaaaaaaaaaaaaaaaagactaaggatatatatcaaaacccttaggcagactgttatttgtaattgtattttatttgtcgtgcttatatgtgttgcccaagttctatggtgaacggtatgcatcactttcagcatgagaaaataactcctaataaacgtgatcttaaaggactctccctgtgtacatcctttccaaggagccccgatgtaccctgcttccccacagccaagctcctctaggacagtcctccctagggggttacggccttgctcctttgatgccctgccacagcccaggggctctttcctgggcactgtggaccagaccctcctagaatcctctccttcctcaaccccagactctcaggcaccccatctctatcctggacaccgagctttcaccaaggcccagctgcagctgctgtgctgagtgtgcacagccacctctgggaaggcttgctccccctgaggacctgggtcctcagtctctgactctggggggattcggggccacctcccaccttctggctctactcaacaccagcagcccctcaacatcaagccctccagctcacgcacctcagctctgcagctccaaagccaccccagcctggaactggggactcagggagacccctcgctccaactccagctggtcccagcactgcctctgctgtcatctctggaatctggctcttgtccccagcccactgctgccagggtcagccctggtactttctacctgggttgctcaacagcttccctctgggggccgcctgttttcagccttgggcccatctgccctccacgtgctgctgggcaagctgaggccccaccacacccccagcaccttcctgtgcctccaggcctccctgccagtacaccccctccagcccctgaagccctgtcagcagctcagagcctttcccggagtcaccctgcttcccgaggggacccacgttgctgctgggcaagctgaggccccgcccaaccccagcgccttcctctgcctccagactccctcctagcacaccctctccagctcctcagtcccaccagcagctcagagcctcttccctgagtcaccctgcttcccgaggggacctcacccagggaatgcccttccaggctcctctcactgattcaccttcactcctcagaggtcggtgctggctgatagaggcaatgaggtgagcccctcacctcagggcgctcagcccctggaaggtgatgaaaaagggcaccccaaggggtgtcccaaactaataggtggatgactcccggggaagatccagtctcccctccccatggccaattaaatttggggtgtttttctttactttttgaggcaaggtcttgctttgttgctcaggctggagtgcagtggcacaatcacagctcctgcagccttgacctcctgggctcaagcaatcctcctccttcagcttcctgaggaggtttaattaaataaattaaaagctaattaaaaacatttttttttttttttggtagagatgggtctcactgttttccaggctgatcttgaactcctggactcaagcaatcctcttgcttcagctctggagtagctgggactacaggtgcatgctactatgcccagctattttttttatttttatttttattttgtagtgatggggtgtgtttcctaggctgatcttgaactcctgggctcagcaatcctcctgcctcggcctcccaaagtgctgagattataggtatgagccattgcaccagcctggattgtattaaggaaactagcttagtcactaaactgcacttctacttctgatggacaagattggcactttgtaaaccaggttttctgggatgctggtttccttgaagatgttctagctggtattatcatataggataggctgagttatgctgcattaacaagcaaaacccaaaggtttatttctcattcgtgctgtatgtccagcaaatgtggctgggcttcattttaatcgtcctcactcccagacccagcctgtaggtgccccaccactgggggatcgctgattgcatggcatggttagagaaatatggttcttaaaggttctcatccagagtggcacatctctctctgctcacaatgtgttgaccaaagcaagtcacatggatgggagcagggagatgcaatctctcttgtgcccaaaagaggagcacaagaaatactgttgaatagcattgccagaggccaagaaaaatctcc

SEQ ID NO: 5024 - DNA, 100000 bp, Homo sapiens
agcagcgcatcaccattgtcattatgatgggggatttattaagggtaaggatagtggagaattgaaagagtagtgcctttgggaaattgttttatttattgttttattgaacaaacactatatagcccttacaccatgacatcaactgaatgctttacaaatattagctcatttaatctgataacaatcctatgagtaagtactataattatccccattgcatagaagggagaagtaggtgcagagagaggtcaagcaacttgcctagggtcccagtgccggtaggtggtagatcggattccagcctttagggtctggaactggagcttgtgccctttgccatcacactgtgctttccttccagcaatgtaggttctgccctctcggcactcaatctaagaatggttgtgccacccaggctgctcttacctacttcttgggagaaatgaaattgaaaacagatgagaactttaccatagactggagaaatgaataattttttgaaagcagttatcaagtattaataggtaatccttgctgctcaaacattcaagcccattaaacactccaaatatacctggaccatgttaaatttgatctccaagtaggaaattctagaattgctttgaaaattattaccgagaagaaatgtttcctcctcattttttttctcataaagttgttgttgttgtttttgttgttttcttatgaaatattctgtcaccatcagtctagatgagttgcttgctcctgagcactcagggagaggatgcagccactgggcaggcatgctacctcctagcttggctctccccaaggctggagtggtagtcctgtgcggagggctggcaaaaggctgctgaattcagggagttggctgggaggttctactggctgtgagcccctgagactattttattcccatggaataagcaggataggaaacgaaggtagagagttccccattggaactggaagttggagacccttgctctttccaggactagcctttcctgcagcctctttgggggcagcagataccctggtagaagggatgcctgtgtgagaaacatttcatgggcggtgacctccttaaggcctgagtgctcaggcttctctttggctcgtgttctcacatgcctgtaagtctcacattcgcttctctctccttcccgtgccaacacagttgtctggattaggtgcctggcttttagaatttgggaagcactgctgttgactactgctgggcctgtgtcctttcactgggccccagggacaagtctttttgtacaagtctttccttgaaggatgccaggcccctctgtggtattgtctgcactgcatggcccatgtctaaaatactaattaataagctgtcacctattaataacactggaatcatcatcacataggtgaagaaagccaaataaactccagcaggccagcattgcagcacagctcttgggggaggagagagagaagagcatgaggaacgtttgaaggggccttaggcaaaatgctttgggccaatagcctgggggctgaatttgaaatctgcttaggaataaggcatgtgtggactttaatgactaaaatccaagcttatggggcaggttgggagcctggagggtttgactcaattgaagtgctagtgagggattagaagaactctctaatgcctgatttctagtgacttggtcttggctggagagactgatgttctcaggtttggttggggtcgagcagtgggaacttagatagaaacactcattaatggatgaataaactgagacatggaccgtaattttttaccccaaatgttattgaaaaatgagtaagtaaaagaaggaacctatgtaatgaggctaaaaatgtcccagaaaaagcacccttgaaattcacatcctaagagtcattagggtggcaggaatggatatgccaagtcttttatgcagaactctgattttataggcatagtcttatttataaatgtgcaattgcatgtattcaatacataacataataaaaccaagttgctgtgaggattaaatgagataatgcattatgcacgccaaatgcctaaaaatgcctaacttagtacctggcgggtggtaaacgtcctaaaatcaaggctggtagctggtataccttggtcaggccaaaccagttgctcttggtcacctccaatctgattggttgctgactggaccatctcagatattaaatattttaaattccactcgttaataatgaccaatactttccattgtggacttcccaggtgccatttactattgtcgggcttttgatacaattctcacaggaagcatttgataccatttttcccattttatagatgaaaagtggaggcttgagatgttcaaaatttggctgaggtctcatggccaaaaaatggtgggctgggatttgaatccagatgtcctgtttgcagagccttgggatcttaaccataatgctctaagtagagggttggcagggggtaacttgtggtagcagttgttattattattgttatttcatcactgaaataactttttttttttcagaatgccatgggcaatgtattcttttgattgtagtgaaattttttcttgctacatgctgaaagcactggtctggcacatttgagaaaagtgaaacagtccctggtctgttctgtccctgaactgagtgaagatggagccccacaatctatcaaaggaaggaagataggcctgtgagagaaccttctaacttaatgacctctgataatgccctccttatcccaggacggagatgagagctgagaaggcctagggtctctgagggtttagttgtacccattgagtcctcccttaaaaaataaaaattagtaccattgctgacatggcccatcatttgggcaaacaactgatattgctttttgcttatggttgcattacacgtctgcaggagacccatcttactctctttgatgttgtctttccctgctattttgtacataaccatttcacaaatttggagctatctggggaatgctggatcactagaaagagccgaatggtagtaactaaaatggtatggaggaatgagacaaaataagcccacagatttcatgataaaaggcaactaaaaggatacaactggagtaattgaaagataaataacacttaaggagcctaagaagtacaaagcagaataaaatgataataacaaatatattcaaaatatataagttaaagtagttagacatcaagggggtaaaatgaagtaaataatagtgactacagtgataccctaaatataagctaaattattaaaagggatataataacttgaaataaaggaatgccaactataggggcagtccaaagttaataatcccatgcaggggcaaatgcagacctgtgggctggggtagcaacatctgttgagtacttctgtggggcaggcatcctacgggtattttattacttgtttccaaaacaactctgtgaagtaagtacaggtgttacctccattttataggtgaggatgctagacttggagagggtaaagaaagttattcaaatcacaaggaatttaggtggcccagaaagattggaatccaggcgtgtcccttaacctctaggctgttctgcagacgcacttctcacgggatgtccttcctaggctggtgtttgccacaggaatcccacaggcgctgacatctgcaggcactgagtcctcaggctctcccttgaggcttccgccctctcatcccttaggtccttcagtctcttcctgctgcccccgagatgagcgtacagtttccctggctattcccgatgtcctgtggatcatggtggctcctttacatggttcttccctcaggagctcctgacatctagagcatcccatgcactgtgccttctgaacttcccttccacattctgtggacaaatttggtacaggacttctaggaaggccaggtaaggaggatatggaactggtggccagggcagttcaggtcagagtaaataggtgggaggtcagatgtcatataaaattaatccatgaaggcatgttcgttgtgttcctaaaactactggataccgtggaggtgttgaaggctggagacccgaagacactaagaaaatgagattgtgatctgaaaggcaaaatagactgaaaagtaggctagtaatgaggaagtgcatatgtccgtctagtcccagcccagatgccactttagtccaccaagcttgcttgatatcccccacctccaaatcacaattaatcacttgcttatcgacaatcccatagagttcctttacattgctctcatgattattttccctttgctttatagaaacacatttctgtctcctccaatgcttagtggagtccttggggttcagaccttgatagattcattttgtttctatgagcatgatgccgggtacatgtgctattaaagtttgctgggtcaggaaagtgctaggtgctgcaagaacatccagtaaagggcagaaatataagaactaccatccttggctggaggaatagagtactgtggctaacaggcaggctctggagtgggatagacttgagttcaaattcttcttagcagcttccagctgtgtaaccttgggcaccctctctaaagcttcaacttttaaactgtggaatggatctcaactgtcaaatagcacaaacctcactggactgaatgagatgaccacgtagtggcatatggtaagtgctcaacagctattagtggattggtgctggtccaaggaggacatgccagtgcagcccttaaaaagggagctggagaagaaaggagtttggggctgattttcacataaggtgccagggcctgatgctgagcaaaacctttgtattgggtgccaccactgtcatctcttgtttaggtttgactggggaaacgtttccacagacatgaactagttttcaaggctggcaagggattttcaagggtttaggggtgcagtctaggctcagagctcagatgcaagccacaaaagagagccatcttcctgagtcaccaaaacacttgattcgggcctctacccttagctggcagccccttaggataggatgggctgtgcctgggtctgtctttgctgcaggggctctgagagaggaagccccatttgtcactttcatttctatgtccccagccccttcagtatgcttcatcctaagcaggcattcaaagtgcttgttgaaggaatagatttgtgtctagttacagccctgacttccactagatgctcaaggattgccctgattttgcaaggaagacaactactcagggaaactgaggcacacttgtaggttagagtccctcagtctgcaaggagcacacacatcctcagcagtggggaagtggtttggttactgaagctgtaaataagaatttgtctttatattaattcctactctgattctagggaagaactctcctctcaggctggagtaggggagaactgagctcagacactgcctcttagttgtgggggctgcaaactgcccctccccatgatatcttctcagctgtttgcaaaacagtcagggaggaggtgaagccctgagccagcggcctgtctgtctctttaaatgctggggtctgtgtgggagagggaggggccggctctgagtgcgtgaaattcctgggctcctccagcagtctcaggctcagcgctcagccctacacacgcctcttgcatgcaactcacagagagggagaggcaacctgtcctcccctctctcagcccggcatctccagccaccaaggacctgcttttcgcacctccaacaacccctcccttctacctgccactccctcccagagagaaaggaaaaggagagagaaagattctggaatttgaaccacccaaagaggaaacatacccagcaaactcagttgattaaacatcaaacagacatacagcagatcccaaatcttctgttcaactggaaaggtaaggtttgcggggaaaggaaggcagtagggcatgaaacaactcaaggttcttgtccgttctgggaagaggttgctcctgagagggagaagttttcagttgggagcaaccaacctagattttcttttttgaatactgtatccatggccttggctgactgtggaaatggcttttcaactgcctttcttttccttcagtttctcctgaagttgggtccttttcctccagatgttggaaaagtcagagaatgttttagatttttatttcttcttctttttttttttttttttttgagtctttctcctatttgcttgaattgttagctgaaatgatgtgtgctcatcacttcattttgggcagatactttttttttgacattttgagtcacttcccccctcatttattcatttatttatttgggctggttaaaatgagaaacagaaggacactctgaggatcacaagaaaacaaaattgaattgagacagggatttccctagcgttgaggaattgacgtgtatgtgagtgtgtgtgtgctttttttttttttttttgaggggtgtgaggaggtggtcctagagtctaaaaattcaggttggactcctgtcttgtgaaggtggcatacttggagaaggtgaaaagggagtgtgtgtgtgagtgtgtgtgtgtgtgtgtgcggggtgtgtgctcctgtttggatcggttacaagggaatcttcctccactgccttccattttttatattaatgatttagtagcaggcttgcctgaaaacttccactctgtgtaagcactggggttttgcaagctctcagtgaccttaaagcctggttcgatgtattgttttttccaggcttgtgctgtacccagagtttcagctctttccctctctcttttttaaccacaaaacttaatgctttagaaacatcatcctgatgacaaggaaaaaaatgtgtccccccaccccccatccttcttaggccagtgatgtaataccaacctaagggctcggctgctttgcaggtgacttacctgtgattacttgttaaaaaaaaataaaattttcccttcctccattaaatgtctgcctctttaatttggatgtagaaatatcatcatgcaatgagaacatcatatttttgctaaccatattggggtttaggtaaagtaggattgctcttctctgatctttattgttaatactttttttttaatgcaaaggtcagagatcattgagagctagcttaggatggagcaagatagagtcaggcaaataaaagagctggtaggacaagagctgtcttctccccgcttccttcggttcccgtttggggagatagtttttcttttaccactacaagccaccccaacattcttctttcttccctccgctgggtcctgtggatggccctgggagggagagggggcactccttgtcacacctgaggatggtgtaattttgggggtcagatgaccgtttgcctttgtgatgaaggttccagtgaaatttgaactcccagcacgctgcgtgacttggtacccaggatagtctatctgggggcactggaggttagtctggggaggctggagaactggctctttattaatttgccgttctgggtgagccttccttcatcgttcaagggcttctgcatcgcctttcaagttaaaatggtcccgcggttatgatgggcaagtttacctaagggctactgggtatgtggcggaaggatggagggggtgagaggaggcaaggctggtatttattttttaatcttcgggcttaatctgcctaagtctatggggcaaacgatatttcagacgggtgctggttgtgcagatattcctattgtttgatttttgttgttgttggggagtggagtaagggctcttggcccattttctgcagcctgaggtcatcctgcgagtcagtcttccttctggaagggggggaaaaggctggacactggaagttcctattaaagtgagcaacagggctgggtttattttttaaaaacaaccggactgtgcgaatcccttttctggagctttctggccctttctagtgaaataataatttaaaaaaaattgcttttgagaagaggagggggcagaaattaaagggattctagattttgagagacagctacgtcttgcttctctggtagttccctattattaattattggggttttgacggcgttctggcctcgtttttgttgatttcattttagtgctgcgtttctcctgactatgttgatgatttgctgctatataagggaaaggatgtattgaggtggactgatgcttggggttttgagatcggctacgagattgggtggcggttggtgtgtttgtcgatgtgcatggtaggaaggtcttttcttttggtggtaggggatgagagaatggtgggagaacggtagatgagatgctacagcaaacgggatgtggggggagacggaggtgaggttggaagtcaccggtttgcagaatttctattctgccccccctttctctcgctcctggaaaaaaaatccattatctataaaaacacattattcttaattggccttttagagaaaaaaaagagagagggaagggaggggttaatttggtgaggggcttggtcgtaattagcccactgctgcaaaagtgagatacagaaatccatcggcaccagcttgggggcatggagaggcagcggagagatgggggacgggttgtcagtcttggatgaacatggagcggtcgggttggcgtctgggcattgtgtgtgcttgtgtctctgtgtgtgtgtgaattttttcatcccaccaccaatctccccctccatcctcccccaattctgccatgatcttccttctatttccacacactgctccccccaccctaggcgcacccccccttcctccagcccttccatcttcatgaaaaaaattctgattttgatggctctgcggctcttttttcccttttccttgcttttttttttttttttttttgcaacacaacagtcgtgcgatggcctttcctactgccacacggatgcagccttctgataggagggcaaagtcggcacatccacacacacactgcatacgctcttgcacacacagtctctgtcacatacacaggcgccaagggcttcattttcttggtttcattccccttaacctctttccccactctacctccaccatggctccttcccccatctttgcatggggactgcggtcacgttagagcctcttttcctctccgcaaccgcggtttctttcttctcgccattattctttccctaaagctgtcgtgtgtcgcagttcatgggatagcatgttggagagtctttgtgggaggggacctcacaagcaggggattggaatgggggtgataacattaataattttttttgaccaaataagcacccagtgataatgatccaatttaacatccatgaaatatatgtttgcggtacattggaggaaggttatgtgggggaggcagagttgacggggttacctccggggagatttgatgcctggacagtagagccacagccccctccccatacacatgtgtacactctctcacacacaccaacacgcacagctctgatcagtgggcttgtcgaaccagagggcactgcagaatatcccagagagttgtgatggttagttgggaggaggaacaatgtctttgtccgacccagttctcctctctacagatgattctgggtcttgaaatcttggtggcctttgtgttggtttacgggtggggactggaagggtgtttgtgttttgtcagcaccagcgtgcctccaattggacaacataggattgtcaacactgtgcgtgtggttcagcaggaggctgcctgcctctttgtgtagtgtggctgtgtttgttggatatgtgcgtatcagcctcatacggtggctctggacaggtgtggtagtgacggggaaggaaggcaagaagcaggatggtcagtggggaagagtcctcaaggtagttgagaggagggtagaggggaagaaacgctcctgcctccagcaggaagcctcaaatgagatccccacgtccaccaagcgaacccgtggtgggtggctcatggatgactggtgggcggatacagattgaagggggagaaggggatgggtgggtgaaattgagggttttccctgctgccttgacagagcctggggctgagctcggggggtggtcttgctcccctggcatcagccacctcttgggcggctcggccttgttggaggcgcagcctgaaggagctgaaatcaccctcggccgtgagagcagcccagcccctgttttctctgggctctggctgccttaactaccggacgccattttcccatcttcagctgaaggtgtgctctctttattagtaattataagtgaaattggaaaacattttgcctaaaagaaaaaaatacaaaatcctcagagcaaaatgctgatggtcttacctttctagcatccctctcccttctggggctgaccctgaggagttagggagacagggttacgtcattgccagagaaaggggataatggggagtaggatgccttgggggtaaattattgtgcccaatgcagagaagagattgctttggtatcccccggccgtgttctccttacatgacccctcaggtgtggataggagacttgaaaagaagaagcattccttctaaaacctcactgcctagaaatgtgctggcccgtggtcgctgtggtctgggacctgctgtggtccggttcctgctgtggtccggttcctgctgtggtcgggacctgctgggggaagaactgttgcgctgcagctctgagccttgagggccagctctgtgctctgaggatgaagcaagtgcggtgctgtggctgggccagccacaggtggccatgctggctcggggcaggttggccatgctgagctcggggcagggactatggatggggcccactccagccctttcctgcaggttgttcctcaaattatactcctcagagagacctttcctgaccgctttctaaaatagtccccttacctcaacctcctggctgctttccagcccatgacactgctttaattttaattggtgaatcattatttaatattatattatacgatgatatattgaaaatttaagatggatctcgtctctttacccctctagaatgcaagctctgagaggtcaaggatttgtgttcattgtggtgttcctagtgcgtaggacatttcctgacacgtagtaggtgctaacaaatgtttgtcgattggaggaaagaaccacatgggtttagtgttggagttttcttcctagcacttggggcctgtcttctgggaagggtggactttgcctctggctgtcttagcccgcctgaatgtctagatctgctggaggaattgcaacatgctcaacttcagtagtttagtaaaagggcttctctatccctggctcagatgactctgcctcctttgagatccctctaatatagtaatcaccattctcatcatcatcatagtagtggtagtaatagtcgtgatatagctatatttctgcagtagttactatttacaaagttctcttccaagtttttttttttttttttaaactcggtatctcatttaattctccaaacaactcaatgcagtatactattattacctgagagactgagacttaaagttacctaataaaatgacagatcgaggatttgaattcagatctgctcatgccagagcccaagcatgggacccttatgttatagtgttagaggaaaaagggagagaatcatctgtcatcttattcagtgccctcaagtacaaatgacaagatggaggcccagaagactacatggcttttccaaagttatgcaccacgtttgatgcagagacaaaactagaataaggtttcctggctgccagggtagggctctttctactccatcatgctgcctggtgggcttgggcccttttccaagggtattgcagctgctgctgtgggggctgcctggggtgccttctagttctctttcttcagaggggagtgaggtcttggtggggcaggtgggtggtaggtgtgttctaaggaaggcacacttgcagagctagaggtcagggtttcatggctcgaagaagactgtgggctatattccagctgagtggtggttaaggttgtcttctgaccttcctgggggaggaaaactggaatggaggaggacccccattccagtggggtgctcaaggttctcaatcccataagccctgcccgtcaagggtactttcaggtccagcagaggctccattcagagagccaagcgctggtatctggatgctgacgactctgggagcctgtcacttctcctagactggcctagcttctttctcacgaagggaagcatgaatccagacattggccccagtgtgcttcatttgtgttccagaggctggttggggggcatgatgtcatacaatatgggtgaaggccttctaccaggtctctgttccactctagggttggtcttgaccttgaatgggagaaggattagacattctgacaagtatgaatgtgtgttttttttttcaggggtggggtggggccagagaaaattggatctgagaagcaaggaagtcttacctttagccaagaccttgaagcagagcatgaatgcattctgcatgaccttgagatggtgtagccagacgccctggtgtggggagacagtgtctgttaggcctttgtcctagtgtaattagtaactctcaaaagtgtcccggtttggatgataaaaatatggccatccttctttaagacgacatcacacactttctcttaaaggaatagagagagaagggggcatactagagagagaaatccaattttagggcaggaaggtgactgagagtacacctttccccagctctactttcacttacccccactttctgaaggataaaaacctggatctctgagtattcctactaccaacatgactactacttctctctcaactactcttactcccatcaagaactaaccaggccagaccctgcttagcttccgagatcagatgagatcgggcatgtcagggtggtatggctgtaaacccaactacttttactaaagcttcgattggccaatatttagacctgactatgggccagatactatgctaagcacttgacatgcattatcttacataatctccaacaatcctgtgaggtgggtactgttatcatctctgtcttacaaatgaagtaactaagcctaaggaggttaagtaacatgtccaaggccactcaggtaggaagtgatgacatcagattcaaacccaaagggcctggctctgctctgaagcctctggtcttaaccactgtttcgaccacctccatgggcctgtcctctggttccgcaagtctggaaacttgattctaagagctgcccatttgccaggcagtcagctgactcacagctctgggacttgctgaaggtgctgctgcagttagaggcatttcaggcttaggaggagggggctgctggttgtagcactgctgcttagagtaatgctgctggttgtcttttgcatggcactaaggaaactctgtttcccaaggtgtcccgttaccttcttccttgcttcatgcaccttgtctgaggagggagttgaggtgatttgggtggtgataggtgggcagaaggtagagaacctgaagcctatttgtctctgctttgctggtcgccctaaacctgcatgggacagccacactccccatggcccttgcagcagggactggcctcagcgtgagatttcagtgaaaggacaattatccagcacctgctttgagcagggcatatgctctgctatttttcacttaggtgggtagtgtcctcatttatctgttgaggaaactgtgatcagaggggttaaatcgcttttttaggattacacagtgagatcctgggtccacactgggtctgaatccagggactctgcaccaccctccatcctgaatcatggagaagaggagctggaattggatcatctaaaactgggggtaaaagaggaaatactctagacagaggtcttccatcagctcctgaggtctggataggaactctggggatcatcatccttatcagccacctctggcctgcctctaccccacacccacaggggaagacacctgctgacccctgagctggagggtgctggttctggcctggagagaaggaggagatgggatcatgcacagcctcactggtggagcgggatgttcagaaggagttacctccttcccccgtggagcaggaacatgtgcactgacacatccccctacatctgtgtcacaggataaagggtgggaagggatgccaggtctgctgctagatacaggcagggaggatgcacagagggaatgagcgggatcccccaggctggaggacccagggaggaagaaggaactttttcttggtggagaggcagggaataggagaagaacagtttctgactgagaggatggtctgcagcccctaggctgagctgcatcagcttcattgcagtccattgaagactgtgtttattttttccaataatgtgttaattaaacatcgatttctgggggaggaaagggaattggattgccagagctaaatggagtgtggcaaatggggagcggttggaggggccccaagctggagtcagcattctccagtggcaccccaggagggtcggaagggactagggctgcctcttcccctggctccaaatttggaattgtcaactctcccagagccttcggaggcacctttcctacttcttgggtgccagggcaggtggagagggctctttgctgaacccagttcaaggagggaggaacaattattctccaccttcctcagcatctttggtttataggactgtgtacccagtctcgtgttcagcatgtgacatatatttgttctttgttttttttttttttgtttctgtttttttgtttttttttttttcttgttttagacagaatcctgctcttttacccaggttggagtgcagtggcttgatcttggctcactgcaatctttgcctcctgggtcaagggattctcctgcctcagcctcccaagaagctgggattacaggcatgtgccacgaatccagctaatttttttgcatttttagtagagacaggggttcaccatgttggccaggttgtctcgaactcctgacctaaggtgatccacctacctcggcctcccaaagttctgggatttaggcatgagccactgcacctggcttggtttttaaaataaacatgggggagggcgctttatattcctactttggagatgtggaaactaaggcttagagaagtaacaagttcaaggtcaagagttggcaaggtttcacaagaaaaggagtcctagcggagttgaaaatatctgaggttgaagaacagccacctagagtcccaagcccctttaaagggaaaaaaagaaaaaaaatgaacatccagtagtaacaaaaagaaccatttgatattttctcattggctaagattggctgagggccgctgcattaagttaagtgctttgcatatgaagttgggaggattcagtgaataagtttaggcaatcattctcgttgtacaggtgaggaaagtggagcttggggaggttaactatctgcctgtggccgcagagttggtaaatggtggagctggaataaatttctgtaaaaaggatttgagacctctacagctgtgttctattgtcccatatacactgaggacatagacactggccaggaagtctcccatgacttttaggaaataaagatgtggaggtctcaggatggaccctcggctagatcctgggccccataaatcccagggtcttgcagtgtggactctatcatcccttctttctcagcccagggcaactcaggcccagcctctggtggagaaaagcctgttttgggggtttgtggtggttggagctgggtgatgagtataagttcaagctgtagttctcaaacttgtgcatattgaaatcaccatattaaaattccaaacccatgctgcacctcacaccaactaattagactctttagggacaagagcctgtcctcggtgtattttaaagcttccaggtgatccaccaggcttgctaactgatagtttggaacagcctctcctgcaaagcaggtgttgggaggtggcatctcttccagagttaggtaagtgtggaggtaattggtcacacacatgtaatatcagtggggcaatgtttatagtgtattgatcagtttttttctcattagaataacagctttcgacttcgatatgcccgaaatgcctagggagtttttacaaaacgggtgtctgcaggcccccctatagacctaacttaaaagttctgaggtggggcccaggaatctgcatgataagcaagatcttctgtggccaggtgaggtggagatctctaggggtagccccgggtctcctttgttcatgcacttgtgaagtcctctttccttggaagggagtgcaggctgaggacatgggttgcctggtcacctgttgctctgtgaggtttggtctcctttgctcaggcctggctatccattgcgacaaagaaagctggtttgcctggcctgggtccctgctgcccactgcagtgactcttgctagtgccttgtgtgtgggcagccctcagggaggaggggatgatcccaacttagaaattcgcagactgccttctcagtttaaaaaaaaaatcagagtaaatctccgcacaacttgagtgtcaggagcctgtcagcagcaaccatcctgagtcttccccctgggattggtgaaacagctctttggggctcattttaaatttttcttctaaagctgtcacagaatagagaatagtcggaactctcagagctggaagggacctgggtgatcactgtgccaatgctaatattctattcacttttcattcatttgttcatccagcagatatttattaaacacctattatatgcaggcacttaccaggtgctgggaatacagccaccatcaagagagacgtttagtttatccctgatggatttaagcttaggtggaagggcaagcggtagacaacacaagtatgtctataattacacatatgatgagtgttctgaaggcaaagtattggggggcactgagaattagagagacctaattagaatgatggggccgggggggacaatgatagctaaaattcgttgagcactcaccgtctgaggccctgctgcaagggcttcacaagtatcacctcatttaattttcacaatgggtcttgagaagagctaatgttattattgttgccttgttacggaagagggaactgatacatggaaagtgcccagtctggaactaaaaccaaagcttgtaaggctctcctacacttaacatcccacgagatgtttttgctgagaactgaaggacagatgggggtcagaaaaaacagagaaattagaaagtactgataatcctggccacgtgtggagctcttagatgctaggcactgtgcaaaacctttatcaaaattatctgttttttgagatggagtttcgctcctgttgcccaggctggaagcaatggcgcgatcttggctcaccgcaacctctgcctgccgggttcaagcgattctcctcctcagcctcccgagtagctgggattacaggcagtgccaccaagcccagctgatttttttgtagttttagtagagacggggttgctccatgttagtcaggctggtctcgaactcccaactcagatgatccacctgcctcggcctcccaaagtgctgggattacaagtgtgagccactcgcctggcctatcaaaattatctcaccacatcctttcagcagctaggataagtaggaatcttatccctttttttgcaggtgagaaaaaataagtttttgggaggttcagtgactttcgtaggaagcagctgggtgtggcagagctgagtctggagccagggcctcttgtctctgggctctgtctgtgcgatggcacagttcccaggcggcggacatctctgcatcctgcctggacacacctgctgggtaatgctaacaatggcaggttgggaggcaaggaggatcccccacagtcattggcctcttgttctgggcctgggagaacccagaataaggatgaaacaagggacgtcttagggcatgccggcccctctgtgctgaaaggaagctccatttttcttccttctggcaagaccatcaggccagccctcttcctggtctgctggccctggaaaccacagtaaatgacttttcaggtaataccctccattgccttttttctctcctcttccctttcatccctagttgctattagtgagatgcttgttacttgcagttttgtgtcccaccctctgcgtggtgcctactggacactgtccctgcctgctcacccaagttgtgtggtcccctggcccaactgagctgaccatagatatgagtgtaggtaggaagaagtacagggacttagttatgaattctgtctagagcaggagaaggaggcaagaaggtgaagaaagagaaaggagatgtgtcaatggggcatgataaatattaaattcctgaaaggtttgccaggatgtggagttcatttctttcatatccattccagtcctgcaggtgagtgagtctgcacatggggacaagtgccccgtgagatagaggttctctatgttctgactgaaatctcttctggggttgaagggctggttctggcaaggggagaactagaagtgggcaggctggctttctgtctgtttttcttcaggtcttggggtaaagggagtccctccatactgggctctgattctgatgagactaacatttgaaagcaatagcttgacttacagatttctgaaatcaagatagaaaagggaaggtggggaagctttctccaagaagggcggatgtgtgggaagtaagaaggttgcctcgtgtgtgggttgtagagtttggatgacagcacttttttctttttttgtacatgtagttatttatttattttacaacaattaactccttcaaatgtgagttgatgattttcttattacaaaataatatatgtttgttatagaacattagaaaacaccaaaaacaaaaataagtcacctataaatctccccgccagagataaccaatggagaattttgatatctatcattccagcttaatttctaagcatctgcaatccagggtgtgtattttgtttttaaagaagttcattcactcatttaacaagtactaattgagcgcccgctgatgccaggcactggaatcacattttggaagctgtcacactagcctgatttttcacataagatgcatcacgaacacttttccacaacagccactcatgtctttgagcttccagatttacttttgggtgtaatgaggcagttggcaaattttggcatctcaagtcttatgtcttaagaggaaggaaacactgcagggcttctctctctttggcgtctatggcagtaccatattagaccctagggagaaaatgtgtctttttactcagaaaataagaaagggagagaagctgttttaacagtgggaaagactctaaccttttatttaatattggcatctggcatttctccaaatgaaggtttagagagggaaggttccattttcctcacagaatcttgactccttagagagtgcaagaaatgtaaagcctatggctagctcacctccagcgtagagatgaggaccaggagtggcagatgacttgtccagggacacacatgtggttgacagcagagccgtgtctggagcctgggagctgaactagggagttgcgcaagtagttggggcagatttggtaaaaagtggtccagccttgctgggtggatggaggaaccctgctggtgttgctcgagtttggatgctgtgcttaaagaggtttatgatacagatttgatttcttcatctctgagatgtacatctggggctgtataaggactgaggagtgagagagaagaagggaatgccttctgcaaagccactgctatacacgaccaagctggttgagctggcactgtgtgggcttccacaaattcaattctgcaagtatctttggacacttcctttgcccagggcattgcatttagtgctaggaatacagagaagagtaaggttgacattctttagtggaggatgatatgaatgtacctaatcactgcaggaggcctcgtctattataggatagagggaacccaggggtttcgatggagggagtaatgacctcctgccgtgaagggagtgtgaagaagtcttccccaaggaggtggaatttaaagaatatcagcagagtggagagaaggactaaggatgacaggccagggaagtagcatgatgaaaggaaagaaatgagagattcctccaaatacacaggggatcaaaatttccagcacatgggtggagggctgataagaaatggggctgaaagggtatgctgagtcagggttctgaagaacctggaatggtagagattcagttaggatgatccctattataagaatcctaacttaatctgaatccattgaggatttgtaggggatggggttcacatgagtaaaatttcaggtgatggacctcagctttgggcagttaggggtgcctgatataatctcagcctaggctggctctgctcatgggagtgaagtgtctgcagcttgagagctcacaccagcacacctcacaatgaagatctggagagaatgactgtccaccagccactgaacaaaattctcaggctttattttggttggaccaacatggatcaatatctgtctttggaccaatcacaatgggacgctcctgtagctagaccatgggtggggctagagtggacttggggagatgcaagagagtgaacacaagcatttggactttagtctgttgtccttggagcatggtatgtattggtgcatggggtggcttgttcatctttgtggtaatgaactccaggggtggtaatgtccctggatttggcagaatcagggacaggaaggacactgctggctgacactggctctactgtctcagcagaagccactaagctgggccatagagccaatctagaatctagtccatggaggtacatttgacacatcttggcattgggcaggaaggagggaggcagagtgaaagggtgacagtaaaggacccagccagtcttcgttggtcaatgttgtctcctatggttttcatcactcttcagagaaaagaggctaagaatcttttaggggatcctagggttggtgctttctgcaaaatacctctaaaaggccttgtggcttcccaggcagagccgaggtgcaggaacctgagttcatgctttatggatttgagtcttttattctttttgcagctgtacatgcatagctcctctaggattggctttgattgatagttgcctttgcaacattacatttcctcagggatctgatgtcttcagaatcgctgcgctggtttccatttgtatttagtggccctcactgggtggttatgcgctctggactatgtttggagaattaatttgctttatgctcaaagtcaataggacgctttttgtttctgctccttgaaatggacgtagaagccttttaatagggggtcctctccctgagctggcaaaagagggcttttctgacttggtgattttcccctgtgtgtggatctgttggggtggctgaaaactaagctgcagtaggggagataaaaggacaggatagtggtgggaacatgatgctccctgatttcagatggtcacactgctctagctgcttttgggagagccctagacttggaagaaaggggatgctggcaaaaaagctttgattacagctttgtcattcctaagccatatgaccctaaacacttggcttttaaatttcagaaaaagtcatggaatacctgcatgccaggactatcttggacatgtgcatgcttcttttttttgagtagccctaaggtgacagtgagcatgacgctcggagttatcaaggggctactttgtgctggattgtgcccaagcttttcgtgtgctgttcagatcgtcatgaagccccatgaggcagtattagtgtcttcactttacaaatgacaaaaacagaggctctgacaggttaagtaatttcccaagatctcttagcaagtatgtgaggtgtaaatctgagagatgttttggtggtgtgttgtgtttttttttttttttcctcaaagcttgcaatgctctgggtttcaagatgtggaggaaaagcatgagctttggggtcactcatgcagacttgggtaggtaactccctgctttttgttactagttgagtgattacctcctgagtctacatgccattcagaggtaataccatcatcttgtagttggggatggcttagaatcaagtgacatgtgcaaggtcatctaatctagtagtggtgcagccaggattggtacccacatggtctgatgttagaatccacactcaacacttcaatcactctggttctggtatataggagctgtggccacagtaataacgatggccaaattctctaataggaagtcttcgcttctggtgatggatggagcaggcatggagattttcttttcattttctctttccttcctaataacctctaccaggattttcttggaagtaggagctgaagagtgagagtcggggctaactgaactattaggattttagttgtttttttttttttttttgagttgggtggggatgtgggataggttgaggcaggaggtacgagaactcatcagatagctggtggaatatgctagaagctttcatgtgtactgtggaggaaggggagtccctatgtagagtgggaaatttgagctctaattacaacttcactaccaattcactgtatgctctttaactttctaaaatgagtattcggtaaattaacacatagggagcactcgggccatgtgactgtccccacatactcctgcacagctaatattgtcaccctggctttagagatggagaaacaggatgattaaatggctcatggctccccagctagtaagtgttacatccgggaccaaaaacaggatgcaggattcaaggtttttcccctataggatacttgtgtttagaaaaagattgtagtctactccttttccaccccatgacagttggggaaactgaggcttagaggtcaagtgatttgacaagatcccacagtgtgaggagccatctgagatcaaggtcatgggatctccaggtcaagttacctcccacctggagcgcagatgtgattccagggagggaactggaaagactgataggcattagggatacagtactgtgtttagagcctgatttctggctcattggaagactgggggcaaatcaggaaaccaaggcagaagcctatgtgcaaggctagacaaccactttggggtcaatgccatggaaaattgggcaacaaggacaattgcagatcttgtaagtaggtggagctctcctacagatgggggaaggtatgggctgctatgttcattgagttcttggcagtgtggttatataatttggatttcttaaggcctaagacatagactttggaatcagagcagccaaatgtaatgcaggtgagttctgtgtgtgcaaacttgggcaagtaatttcccttctcagagtctcgatttgtcatttacaaaatagcaatggcgtcatacctaccctacggattcctacaggttgttgggaatattgaggagttgtcagtaaattatctactttagtgctctcagaatgatgttggcctggacctctcgccagactcactttgtgtatgcatctgcttgatcaccatctctattgtgtgtctaattctaattcaaataaaatctttcttgctttaacatcttttgattttactcctgccccaatctgctcctcccagacttctctattttagaaataggcaactccaccccctagttgctcagacctaacagacttagaacagttttcaactcctttcttgctctcacacccacatccaatctaccagcgaatcctgtcagctctgccttaaaaatggacctggaatagactatacttcttacctctgtggtccaagccgcccccaccaccacttgcctagatgtctcagtgacctccttactgtgctcctgctcccactcttgactctgtgcatttgtttctccatcagcaggctggagtgatcctttaataagtaggtcagatcatgttattctgctcaaaacctctgctggcctcctgttccactctgagtaagccccaaggtcttcacaaccacctgcaggtcccctgggcctggccctggcacccagcaccttcctgcccttctgcctcctcttccatcttttgcctcttctgactcagccatgctggcctccttgatgccacttaaactctctgatccagtcccacctccaagcctttgtcccggcaattttccgggccatttttttttttcctttttgagatggagtcttgttctgtcgcccaggctggagtgcagtggtgcaatctcggctcctgcaacctccacttccgggtttgagcaattctcctgcctcagcttcccaagtagctggactacaggcatgcgccaccacacctagataatttttgtatttttagtagagatgggattcaccatgttggtgaggctggtctcaaactcctgacttcaggtgatccatcctggccattcatgttcccaggtctgtgcatagatgagcctcattgtggaagtctcccccaactacccttccacaacagcactttcctcccctagcactctggccgtccttaccgtacttcgtattcaagcccttgccaccatctgacgtgttacacatgtgtttattttgcttatcacttgtctcactgaatagggtctcatcaccctgaaggctggttggggctttaactggttcacaaacagcccttgtacatggtgagcactcagtgaacacctgctgaatgaacaaatacctttccttcctcttccacaattgaggcacattgttacattgggccacttcttgcctagtccttgagggcaaatgagaatgtctcaccctcctatcctcagttccctttcaggaactaccttccacagaaaagcctggaactttctcattttgaacaggaatacctgtgccatgtgcattgcaaaatacaacacaaactagaaaacaacaaaattcagaaaacagagaaattcatagaaaagaaaataagatcacctggaattccacctcccagaaagaaccactgtgacagccgatgcccatcttcaggctttcctctaagtcacagatttcttctcgggagaggattgggaagaacattatacaatgagcatatcattgaggaagctggtgacagaatgacaatgacaaccagcagtgttgttgataatggtgggactgggaattggaagaatgcagcttgtgtcagtaacatttatttattatttatttatttatttatttatttatttacttacttacttacttaattacttacttactgcttacttactgagtctcactctgttgcccaggctggagtgcagtggtgcgatcttggtcactgcaacctctgcctcccgggttcaggtgattctcgtgcctcagcctcccgagtagtgggattacaggtgcccaccaccacacctggctaatttttgtatttttagtagagatgggtttcaccatgttggccaggctagtctcgaatgcctggcctcaagtgatccacctacctagcctcccaaagtgctgggattacaggcatgagctgctgcccccacccagtgactctctttatatatgaaaggaaatcgatttgtttctaaccatgtaagcgtcctacataagggaagcaatgaaatttcctcagaaaagtacaaggaaaattcattttcccttatttttcaaagcactgcttggatagagctgtaaaaccagaagaactgtatgtttcattacaagcaaattcacactggtggggtgtggggctgggccagggggatgaccattggtgaaggactaacttacattttcagaagctttacacatggtagttaactcattgccttctcatggtgatcttgtgaggggacttcatgggttgcattttacagacagagcatggtggctgaaagaggttttatggctccctcggtatacccctttacaagtgtgatttgaacctagactgactccagagcctgtattgtgactgtgatgaaacatgcttcagagcagtcagaacggagggacagacgggccaacaggaagtgcatttgatgaggctgtgggaggaggctgagaccttcccagggaggacccctgaggcattggcctccgctgcaatagtccctttcccatagctccccaccctgatctagagtgcttggctatgtggccagatagactgggaaagcctggtttcatctctttggcttggaagttccttccagacatgtctagggctggtgtgatggaggtgggaatgtgggagtggtgccacagtgtgactgaatgaggaaaatcttgagatggaaatgatgggggaaccaagcagaccctaggtcactctttagctcagggcctcttgtggcaagtaccaccatgccgatgggtcagattccagaaactgggatgagcaggggatattaaatcatcccttcccctctttgagctgtggccaactcctgggtatctggccctggtgagggggggagggtggtctgttgcactcattggatcatgccagctgggccagtggactgaggtacaaaatcctggtattcctgtgtggggcgccacgaggcccctttggagagatctgagctatatccctgccccctttggctgcccgaagtgtgtgtgtgtgtgtgtgtgtgtgtgtgtgtgtgtgtgtgtgagagagagagcatacagtgtgcaagtgtgtaagtgcagggtgtgtgttgtcaggatattgttacactgcctaaggcaggagatggctcctggctattaatactgctcagatgttaaactgatacgggcactcagtcttatccatagagtgaggagatgcctgtggtgtcattgtcactcctgaattttgaaactgtctgggaaggaggcagagagggactcaactcaggtagtggtacagggcttggggtgggtgcttatttatgctttagctggataggagatactgaactcaccattgctctgcaaaaaagcctctctccgttctgtttctcagagaaaaagaagacttcttggatttcattcaattcacaaatctttattgagtacctgctgggttcagacagtgtaataggtgctggagatggagaggggtagcagttgtgggtgacagctggcagagtcaagacatattttggtgatactctcgagcagagttgatgatggattggatatgaggatgagggagagatcagtgtgaagaaggatccctgggtgttgatgtgaggagccatcagacgcttggcaccgaaattcctctcctagaagggtggtgtggctccagaatgctggggcagacttcaacgcaaaaactgcacaaagaggcaggggtaggagaggccctgggaggtgttaaccactgagcttgaaccttcgcatttttcctttcttaaaagaagttaccattaaccagtactttcaatttcttctcaacctacccaacccttctaccttcctgataccccacctctaatggaatatggggagaagaaattgacttattacaatatttagcaagctgagagaaagtttagaaagcctgtttggcttgggaccccagaggcaaagaggtccaggttcaattctgagatagtggatattattgttgcggacaactcctaaggttcttgggtagagctttaaggccatgagaactgcatgattcagtgcaagcaaattataactaggggggtttggggctgggccagtggataaacttttctttcaaacaattatggagattagtgctaaattaaactttggagcttgtctcatttaacccctcattctggaaatattgaactgaggctcagagaggtttaggattgcataaagtcacacagcaggttggtatggttggcatccagatgcgattttgcttaaataactgtaagtttgggtaggggagcctggaaagcatcacatgaaaggcttttaaagagtcagggcagtgttaggaaacacaggctagccaggagtctgctggagggtaagggcctatgtcttacaaacagaattggctccttttactaaaaacttgaatatcaagcacaaatggactgaagaggccaaagttaggtgtgattcaagacagccgggacaacatggtgaaaccccatctctactaaaaatacaaaaattagctggatgtgtggcgcacacctgtaactccagctactcaggaggctgaggcatgataattgcttgaactggaaggtggaagttgtagtgagccgagattgtgccactgcactccagcctgggtgacaaatgaaactctgtctcaaaaaaaaaaaaaaaaaaaagttatgtctgaactgaccagaagcagagttcagagttcaaggcatctggcagcccctgcccttggaaagccctcctgccaggactggacccatcaatgcatggtggcttgagggctctgcctttctctctctgtacctcaccacctgtcctgctagacatggtatcatagtgcccatcctctgcggctggctgctaggctactctccccctctgcatctggactctggcccataggcatagaaagggggctgtgtctatctccatctagtccagtggaggtaacgcacgctgggtttggagcgaggacatgatgtgcgcccacatcggtcccttccatctgcatgaaaaggattttctagatgcagtgggctgagcaaatcatgagaaaccacagattcatcccattgcagccttgctttggcgttttgataggcacgtggtgtttgagagtacaggactgcaacatttttctttgacatttaccatggaggctctatctggtgctccttatgtctgcccaggagagttgggagaaggtcagggcagtaagctcggtgaacatcttgaggttaaactcaacccattgctggggagtccaagctctgagagccactgtgtgagtcttttgatctctgatgtgctacttctctgagttccagtgaagctgttgccagtggctcagagtgtgggctcctagaatgtgtgatctaggtgaggtcattgccaccttaccctttatagtcagggcctggcctgccgggcctggctgcatctggcagaagaagggagacccgctcatctaccatggttgcctagggccttgggaagagtgggagagctacctatgcgcgggtgggttagaaggagaagggtggggtgagccagaatgagcagaggggctccagagcggatggctacggacaggtggcagtagttgcagaggagagaaggatgatccagcatgctgagtagatatctcagtcttggtcctggtcaggccagcatttcagccttgagccctctcagggcccagccagcaatctacgccccggctggcgctgacccccttggcactggtttgaatccatttgtctttgtgtctaatctgcaacgtgtgcagatgcagaagtggctcaattgatgcctgtcttctggagcactcaggggatcctgggaggctctgttgctcagacatttcagagtgttaagaagcccttggtggagatctgtgtggggaggttaattatgactgtcccccgacccccacccttttttttccctgtctggtaaccttggcttaatttaagtaagttttaaattcaagctgagataatgtttaagaactgtagttcttgaaaaattagctctcagggaaagaagaaaaattaacccgaagaggccagtatgaaccaggcactgtgctaggcattgttcctgggtcatccatttgtttcttcacagtgaccctggagggtgtttgtttgtttaattgctcgatgttggtttgttcattcgttcgttcgttcattcattcattcattcaatgtttgttgagtcctaagatgtagcactcaaggcaccatggtgtagtgagtacagggaagatcaggctttcgctttcatagagccatgattctagtgagaggggtgatagacaataaacacataacaattgataatttcagacagaagtgactgccaggaaggaaataaaacaaagtaaagggtgggtggtgactttagagaggtgcggggacagcccatctggggagatgacatctgagctaagactgagggatgagagagcgagagcaacggaagagctgaggagagcaactgcgggcgtcttggtgggcgtgaactaggctggaatgagagagactgttttgtttgctccattttccagacaagaaactaaagcatagaacccagcttgtccataattacccagcaaagtggaagagaccttctcagtccaaacccatggtttttctactataacctgttgctgtcaataaactgctagctggctccattgtaaccaagtgcttttcctgcatcatcttatgtagtccttgtaaactatctcagacctattttacagatgaggtaactgggctttgggtcaagcaccttatccatggtccacagccagaaatcagagaatgtgggattcaaactcggatctgtatgacgaacccgctgggcttgtcaccacaacataggatgatagattcgtttcccatgggccaaggaatatttccctccttttagagttgtgggagtttgaggcttttcccacgtcacccagccagaaagtgtggtctcccacctcctgggcagggctccttcatctccgagtactgcctttgtccatgtctgcggtcatgagggactgtttggccatgccagcaccactcaagggcctatttgccaatgttggccatagagggcaaattctcaatcttagacaagggctccttaaaaggtaaattatcagaaatagacactgagcacctgttataggttaggaattatgctaagcattgggaaagaaaaaatgaggtgagtttggtttatcttggtgatgaaaagtataatctccaagggtaccagaacacttgaccccactgcccttcttgtgctgggtagaaaagaccagctgcggtctctgcgcctaaaggatctcacaggctaggtggcaacagagagcaacacatatgactgtagtatggttagcaaatctcattcctttatcattttaaaaatcactctctattgagcttctctgcaggaaggtgctgcagtaggtgcaggagatacagtggttcagagggcagacaaggtcctgtcttatgaagctcacatttgggggaaatgaaaatataaatacaaatagggatgaagatataaggagaggtatatggcgctattagaacctaatgggaggtccatcttagttacacgggagaggcttccttacagatgtgctttgacctgacggatgaattggaagcctgcgatcaagacaccctaggttattgggggagcaccaacaaaggcacctagctcaagctgggaatataggttggcttcctccagatggagaagtcaaagtctactggtgagaggatggcttgggtttggagtggaggatgttatgaccagtgggagccatgtgtcatttgggtaccattcctgcttgctcctttaggagaccctcctgctccacaaactggagctgcggaagtgtggcagtttgcttgttcttctgttctccacctctttcctttgagctctgcccgtggctctgtgaataccaacgcagcatataaattatccagcaggcctcagccctcgcccaaccagactcttcgctcagtgggtgcatgcataatcaatacaggaggctgtcactgcttttagctggggtgctagaaaagacttcggctttcagagcttggctgcatgccagcatttactccccacgcctccctccttctgcttctctggctttctcccagttctgtaaggctgcatggcaaaaggttgcaggtgggcctggctcctgtgactgaccccaaaccctcctgtgcagcaattggggaggttcttggttatccgtggctcaacccagagaactcttaggcaaccggcaggctgggcctctcatgctgcttcctcttgctgatcttggcactgccagaacttctgaccatgtctaaagtacccaagtcttgtaaacaggctggcaagagtgggtataagctcccttgcttccttcctggtggagcagtatgggtgggacattcttagctccccacatcttgatggaaggagctgggttgaccctgacagcccctccatggggtattcatgaccaagtattactccttggagacattactggggtcatttcttccagcttccttctcctctcctgctcagatcagggaggagaggggatggcttctaaacacctccagtccatgggggatgtagctgtctcctgacaccttctactttatcctttttgttgtccattccagaaccttgattgagtcctgcctgtatataaagcaatatgaagcatgcacatggttccctacccagaggcaggaatcatttgaaaatgttttcagtcaagagataatatgattccgaagggatctttgcccatcttggaaagatacgaccaggccctgctctcccactcatcctgcggccactgccctgttggtcactgtattggcacagctctgggtggggaatgctctgctgggatggtttctatctggcacatgagtttgattttctttttctgttctctccctgctcagccacaacctcttctgagagaagctgctcttcgcatcattccggatgaggagcagctgctttgctttgtaccatgtcaccttcccctgccctcctccaaccccgtaatgccatggcttattatggcagaggtgagcacacagaactgcccagccacatcctggcttgaattgagagcttaaaaaaagatgagtcaggttgattgttctgctccctcaggagtttaggttggaaaattgagctgctagtggggattcttaagctcaaagatcatggaaaggacttatctgagttgaagttaggagatggtgaccctcagagaggggaggatggtgcatgctgcgaagcaaagtggcagtatcataaaggaaaggaaagagaaaagagggtgcagccaactcctcgctaatgacttattgtcctagcctgtcccattccttatatatgcacaacaatctcttatctaactgtagctggaggggacctttgcttcttgcaaataaaaagtttattaatagttcagtcttctttgaggtgtccagcacttagatgacaccaatggaacagaattttctcaaatgatgggctgagagtaagattttgagttgtgtttccttccagagagcattcagtcaaacctagatgttcttttcctatagcttgagaaaaattcctgaaagattccttagcttggttcatgctggcagattcctgtgagggccagctaatgggcatgtcttggttatatggtggcagagaaaaaacctctgaccagtttctggctgaggaacagggctcctggctccaaggaacattcagtgatggcagaaatgcgaaaagtgttgagatcagcagaggcacattgtcagagctgcatgtggcttaaaatggactttgatgagaggccaagagtagatatctagaaaacatcaggaaggcctctactaagggaagcaagtgcagcagccagagggcagttgagaatcttggccaggctgttggaggttggataaggagaaagtgggcacccaggatgttcactaaggtggtccaccagtttgtctgcagaggcccatttagaatctgagacacccctccccccccacacccaaacacagccttagacacatggcactttgaactaggtgtagggcattctggtttttcttgaagtagcaataataagagcctctaacatttattatgcacttactatgtgctgggtgctctccaagtattacatacacatctgtatatttttttattcctgtgaacagatctgtaaggtagtatcatatttctccatattacagataaggaaactggtgttttgaaagcttaactgacttcccagggccacacaactagctccaggtgaactggcataatgtggttcctggcttctctaccccatgccaagctctcaatgaacccactctgctatttgattggttaatgtgcactggcctggaacctcaattggggtttgtttcctggctctatctgtgccccagtgaacaaaccatctcccaggaggtttgatgagccctgaaggctgttgtgttggaagacacctgctgatgcagcagctgccttggccttttctgaggtggaagcattccaacctgccgtgagccagggagaactccatacattatgtaggagtggctctccccctgcagtggatattgtagacttttgtcctgcagcaggcgagtgtcagctgctttggaaatgaagcatagccctggaagaggggaagaatggagaagaccaagggtaagtgctgctttagggtccctctcaccagattgtgacagtcctggcattcaacaatctctggcaaagctggggcaatggggtgcatctcaggaatagttactgtcagagtagtggttggaaagtccttgctggttcatctgctttgtctggtttggggaacttggtacagcacagtggcaggcgatcttgggaaggaggccaacccaaatcttcaacatctgttaatggggtaataggttatgttgtagcatgagtgagttgtcttaattgggcaaaacttcagatatggttgccgatgcggaaggagactgagcaactgtgcatcggttgtgatgtgcaacttgggggatggggttcatggaaatggatgtcagtcttactgaaactccagtcatggttctcaaggtcacctggggtcccagagtcttctgggaacttgtgtgaaatgcacttctcaggccccaccccagacttcctgaatctgacactctaggggtgggacccagcaagtgtgtttttagaagcctttcaggtgattctgatgcacatggttgaaaaccatagctgtaagtatgctggggtaagtgatggtatggtgtcctagacagatcttgcagctctcaggatggaagagaaaatcctgaactgacttgatattatgtaattattatataattaaaagtgtgctaatacatcctttatggattaaatcagattaatcacaatggttctccaatatctcaggcaaattcctgggtctagctactcccctcatccttgtcatgcaaagaaccttccccagactcagtgggagatctattgtttgatcatggggtttggcaggcacttcgttaaggtggtgtgtataattttctggacctaggttctggccctactgtgtatcagtctcttgagctatgggggcctctccctggttccagggctcagcttcttcatccgtgaaatgaggctggatttggagtcttgaaggtccctcctcggggtgacactccatggttctcagagatgtcccaaggaaagccatggttacatcatgctggaagcagaagtgttgacactgccatattttcaacattaatttggaagtgacagcctgctgaccatctggaagaatctctcagggcactgaagactctggccctgatttcagaactgcattttaggacaggtgcctcattaataggaatgacttcttcccgagatcgtagccaaaacaggctccctgactttgtacagcctaaattctccacactgtcagctgtttgaactctgtggtcaatctctacaaaagggcaggcccctaaccccatgtctttccatctggccgctctggggcttacagatctgatggcttctgctgggcaactttgatggaatgcatgtccagatctcgagctggtgcagaaaaggtggtgagaggcacccagcctgctacgttctgtccttccttggccgtagacactgttcaggcatgggggcagtggtgaaggagaagaagctgggagttggagcagggggagcctgcatcgaggactggttgtactcccttggttgcatgggacttctacgtcagagtgagagaacacgcacaaatctgctgcaattgacctttaagtcaacccgttgcatatgtttgctacacgaaggagctgctgacaagtctcgggctgagacagaaggtggagaagaaaggagaaatctcaccaccacgggctggtgagacagagcgtgggcagagacagagctgtggtgatgctgtcagccgctccgacatgctgttcttccatttctccgatgacgcgcgtctgaagtgtgactcggaggccgcaggaggaaagtgcgatgacctgcaccattcaaagcctctctctgagcaaggtcgccagggcggaaattggctacagcaccaaggccattgaatctaaggtccatttctggctagggcttcaaccaagggaagaatggtggctggttcaggtgcagcccagaatgaaagcagtggggagggagaaactcccatagcgccatgggtgagctgccatgggtgagctgccatgggtgagccgcggcatgccttccaggtgagagagccaagtgccatcctgggtgaagtaggagggggaaacgaaaggctgggtcattgagacaagcatgcctccattaccctgcctgaaaacgaagggaacacctgttcttgtctcagtcagagaggatttgacagaatttttaaagtaaaaagtgaaatgaaatttagatcagctctgcaaaaggactttgtggatttcctgtcggttaaagatgtggcagcattattgttctgtttctggagatgtcaagagtaaaatggtgtgacgtttgtcaagtgcttggacttacttaaccagacatgctgccgggggccttccctgaaggtcacctgtcagggctgtaaagtcagggatgtggggatgggaggaggtcagctaggtcacctgaaagtccctcctaggtctgtgaaaatctgttagatggaaaaataaatggcagggatgggctttctgtttctatgtgtgttgccaggtgggctaaacagatctctcatatcaaggccaacccctcactgacaccctgcgaggaaaacttggttgctgtgggtggggacagtgtccctgccaactgttaagagtccctgccttttccagggacaagggcaagacaggaaaaggggaccaatttccgagtactgtgtgctgactcaggtttgtgatgtatattattttagttttataatcctaacccaatgccataggtgaattagcattttctgtattacatatgaggacacagaggggcagagccattagaacactgaataaagcaacacagctagccagcaagtagagatagacatctaggaccacagcctggtggggctaccatccccctctacttctctggctggggatggggcttgttggctctttcaatcatgggcatgtcaaggctcatatctgagtccccatgcctttctctttacacatgagatgttcctcttacacttatgtccatagagagggctttcccctgggaatgtgccctgggggccgaggctgtgagttactgtgcagatgtgaagtaccaggtgtgctgaaggcagattggttttgagagggggcaactcctttgtttcacccccaacccccatgtgagatgaggcttcctgggcccaggggcaatattactaataattactcattgttggcattttggagctaggtaaagcttctcccattgctactgtttcagggttagacatcagtgacgagtagcctgggatatggcctggctcccaggtatgatgtatttctttgatcctagtctttttcagctgctcggctcagttcaaaactgggtgggaaatgtcacaggctcattttcttgttgtttttcttctgtccccgaggggtatggccacatgcagagaggtggaaaggagggacaggaaatgggaccaatccactgtgttcggaaacctcagttagtgttgctttatttccttcaccaatctgataaggtttccgttaccactattaatacatagtactttatgtgatacaaatgataaacactaatactgaaactttaaaaagtcagaaaagcacagagacagaagcaaaaaaatcactattttcctacacataccattgttgactttttggtgtagatccttccaggtgtgtgtgtgtgtgtgtgtggtgtgtgtgtgtgtttgtgtgtgtgtgtggtttgtgtgtgtgtgtggtttgtgtgtctgattagattgtatacacttctttttttatttgtttacagaaacacactgtgttgtctgattttttttcctgattttagtgttataatgtgagcttgttactgtgccagtaggtattcttaaccttttattgaaagggttgtaaaggtataaagtactccattacagagatgtaacaattactttattccttattgttggatatttaaattctacattttctatatttaaaaataatatgttcctcccgctaaagtttatgccatattaccatcccacctgcagagtataagaattacattttccagcccctttataatgtatttttgctaagcctggcctattagataggcctaaaaagtgacatttttttttttgttttaaccttggccagttctaagaaagagcacgagcattatgaatgggttcttcagtggtgtgaggaaaaaatatgtttgccaccttggtttgttttctttatttgcctcttggtttttcctttgtcagcgtaatgcagaaacactagatctccacctaagaaaaaaggtatataaaaatatatttagggatatttctcacagttttatttataagttactgtgagaaaagttttaaaaagttgaaatatcttaagttctttggatggggaattcttaaattaatggtggtaatgaaatattatgctatcatcaaaataacttaatggtgtaggaaaaatcaagctataaactatgtatattatgatctaaattaaataatatgtgcatagaaaaagactacaaaggttaatgttaatcatttctaagtggcataattgtgctttttctctgtattttcaaaaatttctagcaggcacatgtattattattgtaatcctacacaaaacaatgttagcataaattctaaaatatcatacatggcaataaagagccgtaagtaactgggtttgggtcacttggattctactgaggactttgtaggtgatggagccttttcacgtttttgagtttgtggagttctttggaagttttcaggaccatttcataggaggggcttctaggaggcagagtcaaagtgcggagaccaagagtagctttctatctgaccttctgccctttgtgttgtgggggcacaggtagtgcaggagaaatctatttaggtgcccgctgccccagcccacaggcacgctgaacatgccacccaaggtaccagtggatctcaggatcactgcagttggtgtttgagactgaagggctggggatgccagagggttaatgtctaaatatcattgcgaggactgatggatgtgtttaagtatttctgacaatgacaagcataatggggacagaattctgtgccatccctttacctactgatgaggaaatggaggtctgggggggattaagtcacttgcccatgaagcatctttatttttctttcccaacccagagtaccactggcatggtgcaatgtgtcattgttgggtcttttcagattggctgagatgatgcacggcacacttggatgttgttgaagtcttacactttgcttgggtagagtttgcatgaaagagcattatttaactctttgagtagtggattgggcttcctggaggaattgaggtgaaagatcaaaaagttgattgtggcttggctaggccaagagggtaaagaggagtattccaggtagagggaacagtctgtgcagaggtggaggacagcagggtgcattagagacaaagattgctgagggaagagccagctgcaggatgaggggatgcatctaaagaggtggcagacagctgggaaagggccttgcctgccaggccagagttggactccatgttgagagccaccaagagtcactgaagagctctaaggaaaggagttgttgctcgaactgaaattatgccaagatcactttggctccagtgtgggaatgggtgagagagaccagggctgaatgcaaggagataagtgaggagtctaggtcaacaattcaggtaagagtggtgatggagttaagtggcagtgaggatagaaaggggtaggcaggcagaagggaagagttgtattgagcaattgggaggttgtgggtgccatttgatgaggccaagaaaccagatcaaaagcaaatgtggaggctgctgggaggttgatgaatccaggttggggcatattgtgtttcggtacctgtggggcacaaaagtggagatgccctgtctttttgttttgtaaagtacccatagaggctcacttttttcctctgacaccatggaggagtttctctatgtacaatgagactgtcttccaaaaccttttcatgactgcttttcccaggtgctcacaccattcctgtgaagtgactaggggagcttttctcaatgcagagtgttcagacacagtatcccatgaaatggtgtcgtgttttcttggaatacagccatgcagggggtttccacactgtgtttggatcactcatccccagaaatggcaggtttctcctcctctagtctgcccagaggagggggacctgagtgggaagaaactctctcttgtgccctgagaagaatgcttctctctctgtaaataaagaggaaaaaggcccagagagcccaagagaggaaaaaaaagagtgaaaggctgagatgagattgctccattgcttaactagtggcctccttggttggtagggcagctggcaggactaccgcctgcctccttccctggagttactgtcctgaatgttctcagggtggttacacagacccatcttgggtcacttcatggtcccgtttcataactggcagggatgttggagattatggagtccaaatgtggctcaaagtgggtggtgagcaacttgtccaaggttacacagtgagttggcctccagcttcttttcctgttttgccacatcggacattcttttttttttgtttgttttttgagatgagtcttgctctgttgcccaggctggagtgcagtggtgagatcttggctcactgcaactctgcctcccgggttcaagcaattctcctgcctcagcctcctgagcacctgcgattacagtgtgcaccaccatgcctggctaatttttgtatttttagtagagaaggggtttcaccatgtggccaggctggtctggaactcctgacctcaagtgatcagcccatcttggcctcccaaatgctgggattacaggtgtgaaccaccgcgcccggcctccccacattggactttctaaggatattacctagccacagatctacagggtgtgtttgtttcttaaagcctatgaaaacccacccttctttttggtttgtttcttttatacgacccttaaatgtctttctccagagccctgcacccaccttcttcctgcgcactctaccttttctctctgtgatatcttttctaatcctagcttttcactactgttcaaaggtggatgactccccagttgatacctctagccttgaacttctcagacaccttatattaccgggcttctggtcctctccacccacaggcacatcaggatgacagctgcaaaaccaacagtgttggcttcagagctacacaggcaactcctacttgttctacaatattgaatccatagtaagttgagaattagacttaacacacccaagtctgcgtgtatcatttcctgcgtatctgagtgggtagcatctccatctatccaggaatctgagctggaaggtggaagccaatttcaatatccctctttccccaccacgttagtcatcacgcccttttgttcttcttttaaaatatctttgaactccacttgttcctctgtgtctttcttgccaatggccattatcagctttcaacagaacactttggtgccttcttggggggtcttcctaccaccattctttttttcttccattttcttttttcctgacatatggtggtagaaatcttaaggaataaaactgagcacagcattccttgtgtgaaatactgccttgcctgtaaaatctcattaagtagcctaggcagtggctaatagcctggactctggagtcagactgcctaggtttaaattcttctacttgctgagttagcataggtgggttatataatctgtctgttcttcaattttctacctataaaatgggcgataatattaatacataatttgtagggtgttagaaggattcaatagttaatatttgtgatatgcttaaaaaagtgcctagcacatagtaagtactacttatgtgcatttactacgtgctttgttagtgtgtgccttattaaataaaataaatatatatccttgcttgacctagaggcctttcaaaactggacactgttgacctctccaagctcaagttctcatcctcctgcccttgacactgtgcctgcaataaaactcaacagtttgtcattgttcagtccattgtgcttttccttgtgtttccttttgtccctggattcttcttcttcactcttcctcccacctctcctcccccttataatccttcaaatcagttattcatcttttaaaattcagacaaatgcctcctctctgaggccatccctataccagtggacacagataacacttctttcctgagctacttctgtgcccatgtgtgttttattagagtgacgaggctggagcctctggaggggacagacataattctaattctgatttgaccacctccaagctctgtgactctgggcaattacttaacctctctgagcctcatctgtaagataggagtaggttacctacttgatgaggtatgtgaggattatatggccgtgtgtgtactgagtgccgggtccaactctcagcacatgtaagctcacagcaagtactgtattgttatgatttccactaatacagccattatgtgctattaatttgtagttcgcgtatgtgtccccatgacggttggggccctgttttactaagcttataatcccagtatctcctgtagtagatgatcactaatattgacagttaactgaacttctggcctcaacactcatcatcccacttgagataaaatcagtgtcttggccacacagacctccaagccttgtccccagcaggttggttttgttttcttgaagcttgtctgaaggagataagctgcacctgggaggtgacaagatgttctaaaccaagcaggtggtgtgcagcaaggtgtgaggcttgcttgggagatgtggctggaggtgtgaggggggcctgagaccttggtgggcagactgtgccagctgtgggaagaagaggcaggtgaaacaggaagagcatggagaacctgagtaaaggagagggcagccaggggtggaggattgcggagcagggctgaaggagaacacagagctggacaggtctgctctcagggccggtgcgattacctcgtccatcttcctatctgctctgtgctatattagtctgttctcacactgctataaagacatgtctgagaacaggtaattttaaagaaaagaattttaattgacttacagttcggcatggctgggcaggcctcagaaaactacaatcatggcagaaggggaagaggcacattttacatggcatcaggtaagagagagctgcaagagcagggaaaactgccttataagcccatcagatctcatgagaactcactaccacagaacagcataggggagccaccctcatgatccagtcacctcccacctggtccctccctcacatgtggagattatggggattataatttgagatgtgatttgggtgaggacacacagccaaccatatcatgtaccttgctgagaagtggactttccctgaaccctttgttttaaattgagtcctctccctcagcactcttaattccttcttatctactttattattttttcctgagtcttgtcaccattgggcatactatttgttatatttatgtgtttgtttattatctgtctcttccactagaatttaagagccacaaaggcaagtattttaatctgtttacactgatgtgtcccagcacctagaacattgcctgacacataataagtgcttaataaatatttattgaatgatgaatcccaccacacaaggatcactgcctgtcttagtccgttcaggctgctataggaaatagctttgactgggtaatttagaaatgacagacattttttactcatggttctggcgagtggaaatccaggatcaagttgccagcagattcagtgtctggtgagggccagttcttctagtggtgtcttcaatgtgtgctcacatggcagaagggccagaagggataaataagcttccttggcctctgctgtaagggcactaatcccattcatgaaggctccaccctcgtgacccaatacctcccaaaggctccacctcttattatcacactggggatgatttcaacatataaacttggtgggggaatgtgagcattcaggccataacactgccatttatatttttgtgttcattctttagtaagtaggtttccaaaaatttgtttgaggtgtaagccatgtacaataaagtacccaattttctaagtgtacaatttgagtactggcaaatgtatacacctgtgtaacaaacacgtagtcaagatagagaacatttccatcacccccaaaaagtttttctgtgcctcttggtgtcagttgctgtccccacccctggccccaggcaaccacgatgtagtttttgtcattattttggacttttctgtttccagaattttatgtaatggacttatgtcttgttttgctcagcatacattttaaagatttatctatgttgcaagcagccgtggtaaatctgattttattgtcgacaaatcgtttttttaatttgctttgtggtgttttgtgaccaccagggagcatgtgctgtgatccaggctgcctggttagagttttggcttcaccactcaccagctgtgtggctttgggagttttattctcccagtgcctccagcctctcatctgttaaatggggtaatgatcataccaccttatagtattccagagagaagaattaaatgaattagacacataaagtgcttagagtgtgcctggcacatagtgagtattcaaaaattgttagctgttattacttccattttgcaatgaagagaaaaactcctgaggcacagaaaagttgtttgttcagtgttatttggattgtagaagaattagaattgagatctgtctgatttcactctttgtcctgtcacctcctagagtcggtctttctcttttgggctaggctcttgtgggtggcacacacagaagggggatgaagggaaaagcaggtactcagcttgggggatgtctgaatcctacctcagtgttcacttagttttctccaccgtttcaccctccccaccactgtgggtagagtttcaccccctcctctggtctgcaagggagtggagttgggccttcttgccctttgctcccctcctgggccctctcaggcagtgagccttgcatcaggaacacctcttgcaatcacacagcatcagccctgtgagaagctatttgataaaccccactccaaagctcattgaacctgtctataacgatgcttaattaaagtcagaaactttgaagagatagcaagttactgcttaatgcaataccagagtgccactattcaacgtctgcctctttctctgcagtaattgcttcctgacatttgtttattttaattaggaagcagtcttgatcaagagggagggcagacagggtcagaactgttagggaggaggaagaagtggaaaaggggggctatgctgttgtaggggtggcccgaaggggaatcactgttgtcttatggtataagtggttttatctttccatagggatggaactgtagaacttcctccctacaggaaagcataaggctgactctgggatcatatgcttagggtctgggggtgtcctttagaaatatgggagcttcttggctagcaaatggagcctcctactttgttagaagggaaagtatagtggagctggcagatctcagagtggtgttctgagcacaactaactagattactgtgactcgtggagacacttctagtaccaatagggtctcagagctgagagagagagatggtcattcaatctgttagttctaatggttctcactggtggtttcacagtgtgtctggttatctttgatgcatgttggtcattgtacatgaaaatgatttataagtataacttaagcctgagatgatgaggtgccttcctctacagaacaattttattttatttttctggcagacacttgagggcacataaatcttgcccccacccttaaatgaaattaatggcttgaggcttcctcaaaaacaaggattcaaacccagtctgtagattctcttgaggactagtcaatttctgatttatcctcaccttaggggcccagcttattgtgaggagggtctacttttggtctccccatttcatgtgggtctggttgtggatttttttctctcttgccctgccaggctgtcaaaataaagatcaaattgccagactcacaagatgtcttcagggcaaaagtgattttcatacttgtctggattcctgttcctttcacttttagactagtctttccttactatctgatcagcattttggtgattttagaagatacactgtgctttttaatccagatctttagttgtttttaatggtaatagcctgcattaccagaaagaaaaagtcccctggtagcagtttttcaattagatatatttttactttggtagtggaacttttttttggtcaaatgaaatcttacatagaatctcaataccaaaaacaaacaaaatgaaataaaaaaaagtggagcttttctggttaaaatgtggtttgggggtctcagggcctgccaactaggcctcccttttgttagacccacttagagcatctctaaggaccgggttttatggacatggcttaaaaaactgttctgaggagctccctggtttggctgatttgaggaaccacagctttggcaaaactcatctagtgctttccttggaaacaaatagttcttatagtttaggatggctagaagcctaggccttgggtagcatgctacaagaaaggacaggagtgctgcctgagtcccagagagcccctgtggaagtcaggccaggttagtggggatcatctagtcctcttaggaagactgatctgagatgggggaagagaatggaaggggaattaggatagttctccaagaagcagacatcaaaacaggattgattagacatgcaagaatcttattgaggagatgcctatgtaggattaaaggggagggagcaggaaggagggagagtgttcagacctgatgcacacctgactccagtgaaaggagacagcaaggaaagattgagtaggaagagcccctctgcagcccagctctgagaaagtctcagccaggctgatgggaagtccccaagcaaggttgattgttagaggaatcctgaattggatgggaatggattggcatgagtactccaatggcttggttgttggctggaagcagctttgggggagtggccgcaatgtgaatgcagtgatgatccaaaaggtggtagctgtgctgttgtcaactctgctctctgtggcatgtcctcttgaagagatctcagtggtgcacttccatggctaccctcataggggagggccaggccacccaggagcaatgaggcatttgctgaaacacagcgagaggggagggagagcaaaacatatttttcagacccggggacagctatagtgaactgttgtctgtttattcgccagaaactcagtgtcaagcaagtgggatttgctcagctcatgtgagcatgttatctgagtttgctggcagcaggccatagtagcagatccctcttcattacctaaggataccctgatgtgtctgttcctgtggctcttctaccttacctccagcttcctaaacccttccagtggtttcaactgttcttcacaaaagactgcaccctttatccttgccttctgggcctggtctgggccctttctagccctccttcttattgcctactatgctttcctccctgtccctgttccagccccactggcctttcagctcttgcacttgccttgctcattcctaccacagggcctttgtccatgatgtttcctctgctggggtgctcttccagaagagtctctttccttcatatctctgcacaagagtaacttctcagggagggctggagtcccctcctagtgctctttaagtaccgtgttcagacatggtacatgtgccttggtggcatttgttacagtcacagtttcacatctttcctggctggaatcagaatttccaaaattcctgatttttccaataggctaaaagctccacaagggcaggggctaccctgtctttgctgatcattgtgcctccatgccggacacactcgggatgcttagtcatgatttttggtctagtggataatctacaaagagggtggtaaatagaataagtggatattcgatagtaaaaagaaaataagtgttgaaacaaaatacaaggcagagcgaggcacactactccaaggtgggagtgactttcaaagtccttgtttgcccagcctccttgtcttgcattagaagaaccaagcatcaggaggccagtgacttccccgtgtttacatggcaaggggcgccagagctgggctcacaccttggtttctcgattctgactcgagtgcactctttgctgtggggggcctgcgtggtcacggagcatgagatttgaaggcaaatgcctgggttccatatgggctgtctttcagagttgatttgaccttgaataaaccattaacctgtaggactctttcttcgtctgtaaatgggggtggtcatgtgcattttaaatggaaactttgaatattaaatgagataatatggaaagagtgctcttttgtaaactctaaagtattttacaaatgtcaatactgtgccacgtttagtattttcaaagaagcctaaacccactggagatgggggtggatgggggtactgtccgaccctgttgctgatcctgttcccgagcccactctggccctctccccctgaccctgtagtgagatctttttatgtatttctaaaaaggagctaaaacgtttttggagcatcggctctaggaggagagaggagacctgtgggatggaccagtgttttagcttctgggtccctgctcctcatcagtggaaggaaggggttgcctcatgtctaaaggctcctttcagcaggaagctccacagtcttcatgaacaggacgagctcaaatcaggaaggggaggctattaccagacaggctccaaacagggcacaaagcaaggggaggcggcatggcctccagcttgaaagatttgttagtcccagaaagaactttctggcattcagaatggttaaatgctggacatagagaaggcaacaaggttgtggaaattgcattctggaggtctttataaagagaagaaaaattcaactggagtctgttggaactggggaaatagactaggaagcacccttgtccacagctgtttcctgccgtgctttgttggtgctgggaagtttcgtttgtgctgggggggtttcgtttgtgctgcagggggtggggggggcaggggttagtttgtgcacctaggtggccactctttggatctcccactctgttctgggttctgaactttgaccccgttcctgcttcttccttcttaagggcatccccccagggcttggtctgggtgccatagctccagataataaaaactcagcctcagcagtgatgataaactgctctgtgtgtaatgataacatggggaatttcctgccaagatgaccaatcaagaggaaacagaggagaaagttttgttaaaaatttttagggagcatggtataaaaacttaattggttttatttttgcggccatttttccgtgtgtatctgtctcccttcctcattttaaccctcttgagactggatagagatttcccaagcaagtataaaagtaattatattcaaaacagattttttttttcttcctaaaggtatcaagttaattgtcttttctggggctaattgcttttctttggtccaggtgtgaaatgacagcttagtgccgatgacagtttgcatttgtagtccttttcatatacatgatctcattttgtcctccagatgtctctgtggcttgttcttttgttccattgctcagatgagtaaactgaggtcccacttggcaaagctcacagaaccagttcagctctgctgtgaatgctgctgttttcccatcttgttctaccactacacaacacagcgtggggaagctacagggttccttgttctctagctggccagagcccctgagcttccctgtgctggcaaaggcaagttggcttgagacaatgttttcactggttggtaggagaatgaagactccccagcaatgcagcgagtttgaaaaggagcatagctttatgcattagtttcctgggcagctctaacaaagtaccagcaactgggtggcttaagacaacaaaaatttattagctcaagttctggaggccagaagtctgaaaccaaggtgttggcagggccacggtccctctgaagctctagggaagattccttcctcgcctcttctcggcttctggtgttaccggcaatccttgcgttccttggcttgtagtggcctcactccagtggccacttccatcatcacatggttgtctccctgtgtctctgtgtccacatctctctatccctctaaggacactagggattagatttcagcccggcctactccagtatgacctcatcttgacttgatgacatctgtaaagaccctaattcaaataaagtcacattcacaggtaccaggtgttaagacttcaacatgtctttctcacccacaacacctcatcttagtctagccttcctgcttatttgatttaaaaattaccctttaatacacaaaattatagttctcatagatggtagtttttattttataaatgtatgagactagaaaaatagcaaaccctcgtatttttatcactcaaatgaacaattgacatatattttctaacaatattttttaagaacaaaaatattacaaatgtagatttaaaaattattgttaacatcttctcacttacattatcttctctttttgctgagagcagtggttctcaaccaggacattttgggggtgctactgtcatctagtgggtagaggccagggatgttgccaatcatccagaatgcaaggagagcctgcaacaaggaattatctagtcctaaatgttaatagcactcaggtgagaaactctattttaaagagaagaataatcatgatattgacctgcatccttctagaatattattcattctttttcatacatttacaagtctgaatggtattgtattgtggtattgtttgtgcatgagtattctcttaatgtatataaatagtatttcttttttagtttgagatgggccttgctctgtcgcctgggctggagtgcagcggtgcgatcttggctcactgcaaactcacctcctaggttcaagcgattcttctgcctcagcctcccaagtagctgggattacaggctgtacaccatgcctggctaagttttgtatttttagtggagacagggtttcaccatgttgccaggctggtcttgaattcctgacctcaagtaatctgcttgccttggcctaccaaagtgtgggattacaggcataagcccccacatctggcttaaatagcattgtcttaatgtgtataacagtgtcatcacatattctgcatcttgctattttcctttctttaacatttttaaagattatccatgttcatatatgtatgtgtatataatatacttatgtgatttcttttaactggttgtagtttgttgttttataaaaaggcctttatttgaggcccagtgttcaaaaccagcttggcaacatagcaagaccctgtctctacagaaaaaaaaaagttacctaggcgtggtggcgacacctgtagtcttagctacttgggaagctgaggtggaaggattgcttgagcctaggagtgaggctgcagtaagccatgctcacgccactgtgctccagcctgggcaacaaagaaagacctatcgctctctttttttttcccaaagtctttacttgatgaaataaaaaattaatctttgtccttactaggcacattctctttttgtagggggtcaaattttatttccccatgacattataagtctagaaacctggccagatgccacagggtagacccccagtcctggttagaaagatctccattttctgggatactaattctctctaagaacttaatccttctagaataaagcataccaaaggccccaggagtcctcaatcagttgctaagaagaatgaaattgcatcacaatctaattcatagcatctgtaaggcagggccttccttggcttttcaaattttctaccttcctcatttctttttcttacctttgggattggaagagtcagaagtgatggggtacctaagcttgagagtttcctttaatccttgaggatttctgaaagagagcccctctgtattggtttgaggctgccatagcaaactactacagactgggtggcttaaacagctgaagtttattttctccagttctagaggttgaagtccaaggttttggcaggactggtttcttctgaggcctctctcttggtgggcagatggctgtattctctccgtgtcattacattgctttccctctgcgtgttctgtgtccaagtcaccacttgttataaggacaccagttagattggattagggcccacctaaggacctcattttaacttagttagctctttaaataatctaactccaaatacagtcacttaggtactggggttaggagttttggtgggaggggggatgcagttcagcccccaacaatcctgtccaatatacagggtgactatttccaggggatggggagaatcagtggaaatttcagtgacatctgatgctgagatttttaacccaatgttaaatttaaagttagtaggattggaaattagacctcttaaagtgaggtccactgagattttggtttccaggagacattgaataggtgagaaatttccaaaaggccactgttgagaaacctcatcagataaacacagaagaccagtagcccaagtccaaattattaatctcaaaggccgaccaataaaggactcagtggaaagaccctgatccaagttagaaggcttgggtttcatcttggccctgcctcttagctgtgtgacttgaacaagttacttagactcgacgtcttaattttccccacctctaaagtggaagtaaaatacatcagtggatttatgcaaggataagatgagcacagtgctgggtatctggtgagtttcaaaaatgttatttgttcctagaatctgaatctaaggagcttggactctttcctattgcagaaaggagcttctttagaagcctgggagtgatctctttaaatgtgagttttagaaattaattctggcttggaagcagtacgttaggagagttggaaggagagagaggttggaagtcaaagatcagctattaggcttttgaaataatccaactgatgaagacctgtttgaactgattactgaggtggatggggatggagggtagaagggaagaggggtatagaagagaaaaggaagagaaggaaaggaggagggatattgagaagatagcatcagaacataagaaaattgattgatgtgacagtgtgagagagaggagatgaagagcgtgggataatgcccaggttgctagcgggcctgctgagtggatgagaatactaaggaaggtaaattcagaaggaacagttaagagggaagtggaggaggaaaacaatgagtttggttgtagtcagagtatgtctgagttgtctaggggcatccaggactaagagggtcaaggagagtgggtagtttgtgaagagatctggagaggagctccagggaccctgacatctgaagggtggtggggagaaaaggagcacctgagagtactttcaaaggtgtgcagagagggaggaggggaggcacccgaacatgccaggaagggggccgaaagcagcagatgcagcaggaaggcctgggaggtgggaactgagaagaagctctggttggtattttggaagccactggtaactttggggagagctgtgtgagtcagggacatgtggggcagaagccggaatgcagaggatgaggatagaaagggagagatggagatgatgagtttgatggagaaaaggattacagagaatatcttcaaggcgagggaagagggaagagtcccgtttcttttaaggtaactggcatgctgctgggggcagggggtgagtggggagcctatagagttcaagaaagtgttgatagaacagggtcccagggaggtggcagggcttggagaaagagactggggataagtcagttttaaagggaccgtttttcattgagaagggaagtagggaaggaggtaggagagaaagtgagtagccagaggggagagaagcacaggccttcatgactaaaacctcaatttttttttttcagtaaaaaaggagcccctgtggcatctgaatgaggaaggggaaagggtttagaagagctggagaagggagcatattggggaaaagttgaaggattgctaatagctgaggttgagagtgacagaaccatattgtagttgcatttgttggcatagatggggtttggtttctagtgcctatctgttgctcaggagcaggggaagtggttgcttagattcctaagatagagaactggtggggtggtggaagttcaggggatgaggtaatgattgactatgcgcctcttctaggtaagaagtgaagagaatggagtatgggagggatgatagactgtgagtaagagattagggtgccgtatagctttggtgaggttagcaaggagggttaggaagagacagagatagaaataagattttcctgagataggtatttgctggagaggtagttctgggttggttgaagtccaggtcggtgataagggagtaggaaaaagggtacaggttactggagcggagcacaaaggccatgaagccagggcattgagcacatgggcattgatcacagtagtgggagtagggtacagagggaaacatagccagttaaatatctcagtggatgtgggagagtaatcttgggtgatatattggtcagttattactgcataacaaacaatcacaaaaaactggatgatagcaatagtaagccttgatttagcttccacatctggaggcagtttgatctaggccttactatctaggtaattccagtgatcttgcacctgcagtttggatggggtttggctgatctaggtgttcatagttggggtgggtggctggaatagctctggtcattgacctgttggaactggtggctagaacaggcatgcttatctcatcgtgagggcagaggtgccaaagagcaagcactttcaaacttttggtcatgtcacacccactaatatttccttggccaaagcaaatcatgtggcatgccagaattcaagatatggggaaatagactccacccatgcaggcaggaggcgacaggagtgaatatttctgaacagtaacataattgactacaagtggtaggtaagagctgtgaaaggaagagaggtggggttgcagatggcatgaggcccttgaatgatgacataagcacagagggaagaaaggatactgtctactctgctcccatcctgagatacacatggccccaacacaagtgtttggcagagacatcatttgattagagaaggcatagctttctgtattgtgaggagcaaatatgaacagtgggaattctggagggcacagagggaagaattcgaaagaggcattggaggcagttggctacccagggccagagagcagctgctggagcagggaggtcctagccttggaataaagggcacacacacacacatacacacacacacacacacacacagctgctagaaagcgtgggctcacccgaggtaaactcccacaaagccttattattttgggaaggtgttgtaagaccagccgccacatcgccttgaatgaggctttgggtgcttctcccttccggactaatgaggagggcagatgcttcccggggaggagatagttttagggggaggtggtcacagatcgtactatacttgggatttcacaattgcttttactctggcagggtgttgggaactttttttttccttttggcactacaaataaggaagccagagggtgagtgtgggaagaaaactatttaatggagacacagtgatagaaataacatccatccttggaaagagaggctctacaagaaagtggatgaggtggggcacatcagacctacactttttctctttgcagagcctctcactacttttgaagttcttgatcttcactttcccactaggctctaagctccttgtagtcaaggctgacttgtcttattcatagctttatacccagtgctagcagcacactcagaacataatagggctcaataaatacatttgagtgggtgagtaaatgcatgatgaaaaatttacaagttagttatccatctccacataaaagaattcaaaacttatttttggtaatgtcactcaacaaatattagggtcctcttgaatattaatcaggatgactaggcattcatgaagtgtgagacacaggcttgccagagggttgcatgacttcacttgcagctttgggaacactaactaacaatgcaagtcacgtgaaaatgtttcagacctcagtttgtccacctgcaaaagggggaggctgaagattcattcagatttctttcctacaaggcctcttggaatctttaatattctattgttcatgtgatctctaaaatggggaaaatagtctgatgcttctaaaatgtatgtttttctttctttctctttttgccttcagggcattttgtgggactggttttctatggagcacatgtttggaatgtgggcttgactaattctgctggatcaattcttgttgaatttcttttgaaggtcattccctcccaccctcctagatgtgcttatatcaaatgtaatagtgctttttcccccttatattaggatgggatggctgctttttagagcacccagtggattcaaacatctggctatccttgttctgatgatgttggaggtggatgttcaggtttcagcgttgggttgtgcctgttcttcactttggtccactatccccagagcaccctgaactccatggaggatttgaagcatccaagtaactctttccctgagggatagggggacaaagggactggcttatgtagagatgtggccaaggttgggagggctggacatgctgacctgggacaggatcaggaattctgaaaatcaggcgttccaaggtaaggtatggagtctagaaaggaggctatttgctacattctcactcttttgattatatatctggataggatgtggcttcaggtattgggacactctggctgcccaggcgattgagaatggccatggatggttgagaactaggcacggggatcaagcccgggcccctctctatctaccctggatatgagccgtggccaccttattagtctgtctgtgtcctgctgtatcctttcaaaaccgggtcccacaccatcgaaaatacagactttgtctcatcactccctcttttaaaatcttccaacagctccccaagactttcttagcttggcatccaggacctttggactctgccctcaacaagactttttttttttttaacttttaaagttatctccttattaatatctctatttgatgagacattgtcatacctacatttactttttttgttttattttattatattatactttaagttttagggtatatgtgcacaatgtgcaggttagttacatatgtataatgtgccatgctggtgtgctgcacccattaacgcgtcatttagcattaggtatatctccaatgctatccctccccactcgccccaccccacaacagtccccagagtgtgatgttcccctcctgtgcccatgtgttctcattgttcaattcccacctatgagtgagaacatgaggtgttggttttttgtccttgtgatagtttactgagaatgatgatttccagtttcatccatgtccttcaaaggacatgaactcatcattttttatggctgcatagtattccatggtgtatatggccacattttcttaatccagtctatcattattggacatttgggttggttccaagtctttctattgtgaatagtgccacaataaacatacgtgtgcatgtgtctttttttttttttttttttttttttttgagacggagtctcgctctgtcgcccaggctggactgcggactgcagtgcgcaatctcggctcactgcaagctccgcttcccaggttcacgccattctcctgcctcagctcccgagtagctgggactacaggcacccgccaccgtgcccggctaattttttgtattttagtagagacggggtttcaccttgttagccaggatggtctcgatctcctgacctcatgaccacctgcctcggcctcccaaagtgctgggattacaggcgtgagccaccgcacccggcccatgtgtctttatagcagcatgatttatagtcttttgggtatatacccagtaatgggatgcttggtcaaatggtatttctagttctagatccctgaagaatcaccacactgacttccaaatggttgaactagtttacagtcccaccaacagtgtaaaagtcttcctatttctccacacctctccagcacctgttgtttcctgactttttaatgatcgccattctaactggtgtgagtggtatctcattgtggttttgatttgcatttctctgatggtcagggacggtgagcatttttcatgtgttttttggctgcataaatgtcttcttttgagaagtgtctgttcatgtccttgcccactttttgatggggttgtttgtttttttcttgtaaatttgtttgagtacattgtaattctggatattagccctttgtcagatgagtaggttgcgaaaattttctcccattttgtggttgcctgttcactctgatggtagtttcttttgctgtgcagaaactctttagtttaatagatcccatttgtcaattttggcttttccaacaagactttttagccttacatttttttccactattcgctcccacccatcctgcattccagatagatagaacttcttatggcttcccgacatcccatgatctttcctatcccactgtctttacttgtggttttccttctgctgggaccctcccctgtggccgggtctagcaaaaccattcattctttaatctatcacctccccttaggttactgctcacatgtctatctctcctcacccactaaaccctggctgggatctttgggctccaggaacttacagggtgcctagcaagtagcaggtgtttttttggtgtgtgtgtgtggtgtgttggtgtgtgtgtgtgtgtgtgtgtgtgtgtgtgtgtgtgtgtgtgttttgagaggagtcttgctctgtcgcccaggctagaatgcagtggcctgatctccgctcactgcaactctgcctcctgggttcaagcgattctcctgcctcagcctcctgattaggtgggattacagcgcgtgccaccacgcccgactaattttttgtatttttagtagagatgtggttttaccagttagccaggatgatctcgatcttctgacctcgtgatccactcaccttcacatcccaaatgctgggattacaggcgtgagccaccgggtccggcccaagtagcaggtatttattagagtttgttgaatgaatgaataagggcgcgttgtgttgaatgaaatggaggttgtgaccgctaactccctcttgtcaccttcacctttctgcgtatattaaaagatttatctaacctggaaaacaaatgcccatcctggcatagcagaaagatgggtattttaaaaagagagagagttttttacctttcaagcatagcaggtttttgaaagctaagatataaataggtactaataaggaaatgggaaaactaatgcaaaattacagattgtattagtcctgattgtataataatgaatataaataaaggaccataaacattccagaattatccagtgagcccagaagttgaagccatctgatagaataattttttgagtcttgggtttgaaaaatatactgactttttaattaaaaaaaactttgaaattttttttgctgttaagtaaaacctgaaacttggtagagaaagatgtattggggcttctaccttttgaggatcatggaaactgtattcaaattattacaattctggttagcatccctagatgagaaggtttgatattatataataactcactgtgacagggcagatctggcataggtgggcccattgtgtgccatccaaatgcatttaattactgcaggatgagccataggttttatatcatatgcctgttgcaactgatgggaaggtagcacttcttagactttggttgagaaggattctgaagctccctctgggctcaacattatggtaccatgattaataatgattgattagtgaagtgtgctgtgaacacgtgtagggaagattcatgtattttgccccttatctaacatatcccagaagcagtggtataatactaatcagtgtgatatatgacagaatatgggacttattcagaagcttgaatttaagattcaattgcatcacttactgttttggaccctgaacgaaccatgttctgtctctgagcttcagtttcttcataggtagatgggagtgaaaaaaaaaacaccttatttgtcatatggaggttagatgagacagagttactttataacattagtgcctagcttttctaatcaggcttatgagatcattgctgtatgcagtcagtattacttgtttgctccgtgcatgttacatatgatggtttctgtgcgtattgcctgttttcattctcagctcacagcacaggaagctttgctggctcactgactttgcacacccactagctagggctctcaccagagcacctcccacctctttggttctctgcggtgacgtccttcagctaggcagttaacaccgaagcagacgaggctgaagtacatcgtggtgcttataggcttggagttccattctacttaacttactatgttaagtgctcgtagtaaatttggagctaagactggacttaagtttccttagctgcctcaggactgcgtctctagaacgtcatagagtttaagcttggccaggaaaactgggatgacagttctattctatgtgtctcatcctctaggaggcggcgtgggcatgttctcatggcaaaggagcaagagtgagcaagcagaaaatatgaaaatgttttcaggcctctgctggtgtcatttttgctaatatgccattcagcgaaagcaagtcactgtctgagcttagtgtccagggctgggctcagtgatgttaaattgccaagggtatggagtggggagagtgaagaatttgagacattaatacaatcaaacccaatcaaaccactacacacattatgggagaaatcgctgaattttctttcttttttttttttttttttgagacagagttcactctgtcgcccaggctggagtgtaatgcgtgatctccgctcactgtaacctccgcccccaggttcaagcgattctcctgtctcagcctcctatgtagctaggattacaggcgcctccactacacccagataattttggcatttttactagagatggggtttcaccatgttagcaggggatctcgaactcctgacctcaagtgatctgcctgctttggcctcccaaagtgctggtttacaggcgtgagcaactgtgcccggctagatctctaaaatcatagcgtgagtaaggtaacagaaaaatagtaatgatgataatggtcatggctaacatttactgaatgcttgttattaccagtctgtgctgggagcctattgcattttattccatactgaatcctcacaataccctttcatgtaagtgctaatattacctctcgcattttacaaatgagaacactgaggttcaggagattaggtaattgtcagaggttacaaagctcctcagtggtagagctctggaataagatccagttttatctgactctagtctagctcttaactgaatcccagaataccagaaccttgggcagggacaccccttgaaatgtactacaggggaatctagggcaaacaatgagcaactcctttcatgcggacggtgataacctcaaggaatgtgtcccccaaatgagtatttactgatgttccctcatgctcagatgtgtgaggttggcaaaagttataagactcagtaaaaaggaatgagtaaaaaggaaaaatgagtaaaaaggaaaaatctgttcaagaatttttttgcacattgtgcaaatgacagctcctctgtggctttttgaggggaaagtaggagattctagggatgtcccttaaatgttgaggttggtataggtgcagtggttttgaaactgttctttgggactcgtagagtttcacactataaaatcttgatgactattgtggccgtcatgggggaggctgggagcaagattccacctcctacttctgcagagaagctctgcttttaactgtcttatgttttgggtttacttctttttttttttttcaatcagagtcttgtggcttaagaaaggaaagcccgttataatggaaataaacccggtcaaagggtcctgatagttgagctgtagtgccacttcgccaccgtccagtcatgtaatcttgcacacttgcttgatgatccctggggttcttctttttcatctattgaatgaggggcttgggctggcgatcttcactgtcctctccagatctggtttcctcatcttccaggaggggcatctgtgatctattctactgccaggggtgaagttctaaactggtctgctagtgatccgaaccagaatccctcccttgaatccttcaaatttccgtcgcttcccaccttagtccagtcagcaagcacatgtctatgatcgactctgtgccaggcacaaacctaccatcgttctaagctctgcaggtcctaatacttgccctggcctgggagggtcgaagtgtgccctcttgctgtgtcttttctttgccactatcttccttctttatgcctcactgtttatgtcttcctacaggacacagtgtgagggttggtagcaccatatactctctagggttggcagtggaggggataataagtggggacctaaggatgttgcaacagatgggctcacgggtcactgttccctctccagttctcttcagccattgacaaggatgctaagttcatctgccaaagtgcttttccaatgtagatccctttatttttatttattttgtatttttcttgagcagggtttccctctgtcacccaggctagagtgcagtggcacgatctcggctcactgcaactccgcctcctgaactcaagtgatcctcccgcctcagcttcccaagtagctggaactacggcatgagccaccacacctgactaatttttgtatttttagtagagacaaggtttcaccagttgtccaggctggtctcaaactcctgagctcaagcaatctgcccgtcttggcctcctaatcccttctagccacctctgtctctgtctctgtctctgtctgtctctctctctctctcttctctggcagtgacttcctcagcaaagggcagaattgaagtctagttgtttgtcgggagacctgcatcttttattcttctttcctaggtgatggagaggctggggtgacatggaggggacagttcctatggaaggagagaaggctggggaatgctagctgtgtcaggcactaaacctccatccttctaagctctgcaagtcctaaaacttgtcctagaggagacactggagtgtgggacccagagaagagggagtcagccatgagaaggtttgaagaagggcatttcaggcagtggaaaagaaattgcaaagactctgaggttgggctgcacttattgagttctgaaaacaccaggaggtagcatggctggggcacagtgaacaaggggaagaggagtagtagatgagactggaaggtggctggtgtcagaccgtggccatgtggggtctcaaaggccacagggaggactttgatttcattctgagtatgttgaaaaccactggagggtcttggatgagggagtgatgactccattttaaaaggtcattctgactgctgtatggaaaatattccataaggagcaaaggtgaagcagggatacctgttgggagaaccgtatatagtccaagagaaaaagaaacactggtgagtagaattgataggagtgcagcttacggcctcccctgtgaggtcttgggatgcagggcaaacctggaacatcctgtcaacgggtaaggaaaccctggggagcctgaaggtagaggagagagatggtagattgggtgaggggcatcacataaactctggagctagacccagttctgcgttattcattcattcattcaacatatggtatccatattctttttctcccccagagaataattttctttagtccttgaggactcagcttcttacagggactttggcagaggtcaggggttagtgccttggctctaaattggggtgagggtgtttggtccttctaggcatcacagtgatcctgactacttgctatgaatggcactactcatgtagtaatgttgtttcacatacagcttggaggcacaaaagccttgaagatacatgattcatgcatgtcctgatggctgcagtctctctgtattttggatgatgagcttcttaatggccttgtccttggctacacatagggccaaatcatgcaataaataggctgaatatggctgtggtcctttttgccatgactgttgttcctttcctcattgtcattttggaagtgaggagctgagatctgcacccttattagcatatgacttggaaaaatgacttcattttccagaggcctcagtttactcatctccaaaatagggataaaatagttcctacatcatagaggttttgtaaggattaaatgacttcacgtgtaccatactggcatagcgcgttgcccagagcaagtgtattatgagtgtttgctgttgctgctgtgttgaaggtgtgtgtgctggaagaactgtgtagcagcctttccactggctttccaaaatcacaaaggaccaaattgtcatgggtctgggtcctgagcacactgatctacactgtcccctttcaggggctgtgtgtcatctgctcctggctcccaggctcagccttcacccccattgtaaccttcctggaaataccttttgtgggcacattgctgcccctgcttcctgccccctggcatcaattgctctgcaggaggtgtggtctgtgcctcatacctgtgaggtgtgcccggtagatgggctgtgccaggccccacattcaccctgtggtgaagctgggggctgtctggtctgggttccacagttcaaatctgtccagagcctttgccagtttgttctgttctcctcaccagctctgcacctcttgctccattaatggagaatttgtcaagtaatgggaataattagcacagtggggctttactgtgtcctggaaagagaacagagagagccctcccagcagccccagacatgatgctgggcaggcttattttctcttgtctgcgcctctctccccttctcttacatgtgtttgtttttttccccctctttgtgtggagagagttggctaggagaaaagactcgtaaattgcatcttgctgggctggtgctgcgaaagctggataagattgtcctctagggctgaataatttcctctccccttacccgctttgtggggaaagatcagctaagcacctagttcattttccccccttttccctctccattttttctctctcccccagccctccctgcttctcttccctatccctcatgtaaagaattcactggctttcaattgaatcttttttaatggtcccaagaggggagatcttgaagggtgattatcttcattataaattattaactctcccagcagccagatggcttccaaaccatggctgggaactccaggctggggaggcccactggccagggaggaggggggagagaagggaggaggctgaaaagtaaatggccacagcttcttgggttcctggctgtacgaggttgctcgggagcctgttggcaccttacaaggcctgagttctttggtgtgtgagagagagtttgttgttgttgttggttttcacccactagagaactcagggtgcaacaactaggtaccttggggatggagtataggtagtaggtggaaaagagactgttgccatgagttgctttggtatgaaccttagaagattgtcaaggcatggtaagagggcatgattatttctgtccttgtgtagtctttgatgtgcacatcctggaaggtgtattcattgttcttcccaatttatagagaagaataaaaaattgaatagatccagaggtatccatatggttgcttggccaatagtagtgaaaagacagtctggttctgacttccaatctagtggtctttccctgacatcagattctcttccgcagttgcttatgccctacttgtccttcaagtttccttgcaggttcctctccctgagaaacctctgaccgcaccagccctgagtcatcttgttcctctggattgtattgtatccatgtatagacctacttagtactggacatagaacccctaaagatgtccagtctcttcgggtcatccccagtaacagggagcccgcttcatttggaggtaatctgcttctaagataagacataaatactctctgtagaacttccgttcactagacaaaattctatcctggagggcatagagaaaccgtgggatcttttttccaatttaagtatgcttcaaaaaaaaaaaaaaaaaaaaagaatgcttcctactcctgtggacactgctcctgccactgctgcattgcctgtgttgcccaaacaccctgacacctccaaaaatttctcctatagagactcatgtatgactctcccattgtctgtgacactggaatgaaatttaaagaagtccatctacccagcctattctcccaagcagtccctgtgatatggcttagctgtgtccccacccaaatctcatcttgaattgtactcccataattcccacatgtcatgggagggacctagtggaaagtaattgaatcatggggcagatctttcccaagctgttctcctgatagtgagtaggtctcatgagatatgatggtttataaagaggagttcccctgcacaaggtttctcttgcctgccccaatgtaagatgtcccttgctcttctttcatcttctgccatgattgtgaggcttctccagccatgagtccattaaattctttcctttataaattacccagtctcaggtatgtctctattagcagcttgagaatggctaatacatcccatgagacaccaacattagccatgctgctagcatgaaataataagcataaggacaacagtggacagcaacagtagataacatttatttggtacttatctgtgctgagattgtcctaagggctttcacttgtactaagtgcctacgtatgataattcattgttatcactgtttcacagagaagacaacggaggcatggagtggataagtgatgggctcaaggtcactaggcatcaagtagcaggtctgagatttgaacccaggaagtctggctctagagcccatgctttaaccactacattatcccgcctgcatgagaggggcactcatcctagcaccagtctttactttggaccctagaggctaaccatcaccatatcaagcccacacttggcagagtctgctctcacatttggtccacctccttatattatttaggctcatgtctttcctttctactaactataagtgcctttcagggcttgagctatttttatttatttatctgtatgtctggaacatggtgctccatggttaaacaaaataaatgaaaaactttcttttcattcactatctttcagttacctacacctttctcagagtatgactcagaataaaaattcagtgactggtcagattgcacagatgatgatctctttcttcctataagttatatttcaattaacatagtctaaaattcatttgattatctggcagccacaaatgcttttatatatatatatatatatatatatataatgtgtatatatatatatatgtgtgtgtgtgtgtgtctttttgtcaatttaatttctcattcttgtttactatatagttacaaattgtaccttccatccttatgggttgtttatattgaggatcaagttgcattcctttccatttatctccatcaaattttgtcttattagatatagctgtagttttagcctatcatgatctcttggagtcccttcagcctcacctggcacactcaaactctcagtgtcagttcatctacacacatgattatttggctctctccatcttcactgggctcttgataaacatgaaagatgagatcaggcctgacctcccacaagagcctgtgtcctatgggtttgcgccttctttgaatgctgttctttagccagtgaccagtcttcttggtctgctgcctcacagttctcatatcatgagaagatctgctgaagtccatatataactcatgtgatctctaccataacagatcagtattcttgacagaaaaggaatttaggttagcctgacatacttcttagttcttgggaaaacttagtttttagtaaaaaaaaaaaaaagtgttatagttaaggttaaaaaaaaagtctcttcctgtctctccccatctccattccgctttcagcacaaataaacttcaaatgctcttttctatgtgtccatttgttaagaacagaattaaggtccttgaggctgtttccccttctttttcctaaagggtaaggcttggtgactaagactaggatcactccgcagatttcaggaaaagaagagaagatgcaagaagggtggtattcctagacatgacaaattatgggagagaggactagggtatagagtgggctcaaaagagaggacagtgagctcctattgcaaagcatggtggatatttgcccttagttttctagaagagaggttggttttgcttggggaactgtaagaaggaagttccagcctacaaaacaggaactagtaataattttcttaaaacccttcttcaagtgacataacaaaaataatagattaacatatatatgtatcagaagtgcattaagttgcttttattgaaatatagcatacatagagaaaagcacatacattgaagtatacagctcccttgttgcattttcacaaactgaacacattacgcagaatcacccaatcaagaaacaggattccttcacccctttgccttcttctaatcattaaccactattctgcatttaacagcatagaataaataattttgcctcttttcggtttacataaatgaagcacaacagtatgtgtcttactttgctcaatattatgtatgtgagattcatccacgcttctgtcagatgaagagcaatcattctcaaagctgtatagtattttgcatgaatagactacaattttccactctactgcaggtagacattgggtgattttctaggttttgtctattatgaatagtttgccatgaacattctcatgcatattttcagttggacatttgtaagcatttctgttcgttatacctaaaagggtaattgtggagtcctggggtaaaaatgttcagctttagtagatacgccagcataattttccaaaagtagttacatttttataaatttttaaatttcatgaagttaaaactgccctatgagataggtattattccccccccccttttttttgatgaagaaagaccaagagagttgcccaaggttaaatagctataggaatgagagtctgggtttaaattcagcgtgcctgcctccaaagcccatgttctctctcactagcctgaactacttttatatctttggagaattcatgccttaacctccctcactacatgcagtagagcctttgctgttgtattaaatagatagtgctgactatgtgagcttgccctaatggtgtggtgtctggaggggtacagttaattgagggagcacatttctgaggttcttgtataagaacaagcctctgtccacctgcaaacacacaagaagagaaacaagcccatatcctatgcctttgttcaagtgcatgggcaaagggtgtggagagcattgatggcaaaggtgggtaagacatgaggctcaggttacagggagtctgggtgtaggtggccatatgagatggaagcttctgctagtttgtcagtgacaacagtttttatggtccagtattaggagtgtatgagtcaggactcttggtcacaacccaactcaacttgctaaaggaaaaaaagttttggttcatgaaatggaagtcacaggattcattgggcttaggtctggctagatctaggtgttaacaccactagaaatctgtttgtatctatttcttgctctgatttcttccttgttgttttcattattagacaaaatcctctccaatggtggagatgatcatactccaccagtaatgatggtgtctgtcaagtttgagcttcactctaataatttttgatgtggtaagaagagagaggggatccttttcacgataattccagtgaaagtcccggattaactcaaattcaacttcaagtctgggtgagagacccatcttgaaactaatcactgtgccaagagattggaatgtcccagttgactaaactggatcatatgatttgggattgggataacctcaccttgaatgacacagaacgagattggtggtgaaaatcatttacctgcaaagtgggtgaggggagcagtgaacatggggcaaaaccaccagagagccactggagagattttcagtcctggtgagggcaggtcataggaagcttctggaagaaaacctggtaagccccacctgggactgtgggatgcccgcaaaggctgggcacaaggacagtcatcatcgtgacttcctaatcaaacccacttgtagacagtccgacttccttgagtctgtctcaagctcagctaaagcccaggcagttggaaaagggaggaatgaaattggaaggaggggtggggagggcaaatggcgccagatcttctgagccacaccttgtggcaaatagcccacatgtcagagttgtgtgagccccccccaccacaccaccctgccccctcctaagcagccggcttatgagacatttgcaaaatgttaaccccacataaaaagtgtgccgttcgataattatgtaaattagctggcaattaataatgtcactcactttccctctctcgcttgattcccacacaacagagaagtgttctgacttctgcaccagcccgggccctgcatgcaggctctggggcaaaccacctgtgtgcgtggtgcctgcgttctcctatggttcagtagagggtggcagttgtctggccaggtgaagagggtccctggctcccgttttgccatttcttgagtctagcatgccccaccagaggggcaaagaggctgaaggataaacgctggcagcagttggaggcctgcgatatttagtgtaagggcatcctagcttttggccattttggcaatttcccagaggctgcaggaatgtccaaaactaggaagaaaaggaagggctgtaggaaagaatgtggatagaccatagagggttaagtctacataacccacttgtgatgttatcacttctgaaactggattctgcctgtgggaaagaaagcttggtttcctcagtcagcctttttgatcccccacaatgcagggcagggaatggtggtatccccagtgctggtctgggctggaggggaaggatgagggactgaaggaatggggaggctcagccggaaggggtgtgtggccccgacaaagcaggctaagtgcccatgatcttcccccacaaggaatgtttctgggcagcagagtttttcattcatgggtttcctcaggtcactaagcatgtgtgctttgctcattggggtcatgtgaggttggcatccagagaggcatgggggttcaggatgatgtccttgtgtaaagtggggttgtgtggaggccactgcatggaacagaagtcaaatatccacaggaacattcttccacttctgcttttactgttcattctatctacaagtgcttccaaactccagctccatgacgaggccctgtggcagacaccatgttgaagcagtcattgcctcagggagccccccatcagcaatctggttccagagcctgggctcttaattgccgtgctttctgtctctgaagtaaacttgtcccccactagtttgtgatgccctggagggtgagattgggtctttattttgctttgatccagtagtgcctggaatgaattggagctcaataaacagttaattgaagggttttctctttcctttgagatgttgccctttgacttggttggcatacctccctcatacaaggaatcatattcttagaaattgtgtcacgtttcatgtcctaccctcctgtatccatgtccggcttcatgtcttccactcactccgctccaacagcacctacctcctgcgttcttcaagtataccagcttgctccagcctcagttcttttacattgactattatttctgaacattcttcccagatacttacatggctgattccctcacactctttcaagtcttttctttctttctttctttttttttgagacagagtcttgttctgttggaacaagtggatggagtcagtggcacgatcttggctcactgcaaactctgcatcccaggttccagcaattctccctcctcagcctctcgagtagctgggatcacagtcgcctgccactgggactaatttttgtattttagtagagatggggtttcgccacattggccagactggtcttgaactcctgacctcagtgatccacccacctcggcctcccaaagtgctgggattacaggcgcaagccaccgtgcatgcctcaagtctttacttaaatttcaccttctcaaatactctttgtggtgtttgcctttttctggggtgtaaatactccttgcctgtttatttcatgctaccaaagtcatgccaaccagcaaagtttttgaaattttagcagttggctctcacaagcctgtatgagttggcaccagcaactcctgtgtccatgtctcagctgagcatcccttgaaccactgggggtacctgtgtgtaggtaaaagcacttgataacaataacttgagcataccctgagaatgaccctgcatggcagtgcacttgaatgtgtgtgtcctacgctagggaacctgggagtggccaaccaggagattcttccttctctatgaggaacatataagcccctggctggtcccatggaacatgggctatacggggatcaaggccctttgttttagggtaaatgaaggttgccagatagggactgttatgggagggtgctaagtaaatatgctgtgtaaactgcatgccttttgcaagcagttgcagctccctacccagctcaccaccactggactctctcctctggatgtaagctccccgttaaaaccatttctcatttgtcagctctgggattattcttctgcctcttgaacctggtaccttcctttcggagtctatggaagtttggcacagcacctgtgccacactttagggaacattgcttggcaaagccttttatagaacaaagcctttccttataatggatttaatcagccccttgttcgtgggtttgtttgttcattgggaataggtgtttgttcctggttaaggaacagcagcttcccttcaaagaaggggtaataactagctttgctgatgtggttatcattaaaataggggatataatgttctgatggagcccatggtgaattatcaaatgtgccaggtaataagcagcaactgcacagctcctagaaatcacactcactgtttgatctgaacagagaactcaggcgggccaagtctgccctcagaaaccagactgcgtgctggtgcatttctaactgtttctacatcatctaaaatatatgtaatatactctaggtcatttggaactatccagtgtcactctaggaattcttaactattcagttgtcatccattctgcagttttcataatctttttcagtacttttgttttacacattgctcactctatagccatacatacatccacacatacacagacatacacaataacccctcctcctgtcccttcccacttcagagataaaggaagagacctaggatttgtttcacctcctatgtataaagcctcatgtggccagcagctgtggctcatgcctgtaatcccgcactttgggaggcctagatggggagatcagaagtttgagaccagcctgggcaacatgagaaactccgtctctactaaaaatacaaaaattagctgtgcatggtggtacatgcctgtatcccagctacttgggaggctgaggcaggagaattgcttgaacccaagaggtggaggttgagtgagccgagctcacgccactgcattctagcctgggcaaaagagcaagactctgtctcaaaaaaaaaaaaaggcttatgctaggatcttcctatacctgatttcattgattcctctctcaatcttgggaagaggctattattttctctactttacaaatgaggaaatagaagctcaataggttaagaaattttctcaaagtgccacatacaggagctaggattcaaactcagcctttttttttagaaggaataaaataatcctcctctcttaatattcagtaagagaggaggatattttactcattactcaccttccagtttattttcactgatttttataaacatttctttccaaatttaggggtagcaatttgccttaggcttcctacagtgagttgtcaaattgaaaagaaaaatctagaaaaaagttaatgtcatttgcaagcttttaataggtaaataagtaaaaataggtgtgggtatttgaatatataaaatgttagcacttatcttaaaaatacactttgacatgtgaccttgtgatgtgaatattctaataatgtgctgatatggctttggggatttttatatttttacatatggaaaacctgagtgcatcattaggacctggtcgtcttgtagtggcttggaagaacccacggcctccctcctgtttgaagcactaagcactgtagcaatcactagatagcttggctcgaagtcagcattccatcaatacttgtgaaataggatgcaatgttttccgatatatggtcctaatcttcctctccttctccctccccctcttcccacaggtcttttcttggagtcctgggaggcaagttatgggcagcactgcttctggccgcaccatgaagcctgatctgcttgcgctctgcccagggccctgctctgtctgagcattgggcttctagctgccccctccccacagcctgccgctgctaggaggtagaactttaggagtggtccttggcctgttttacctgtcacctggctcacctcaccactcactcctcctccatcacagcaccccggccctcctgtccctggcctccctggctggggcatttgggggtccgctgggaggagtgcatcgctaaggcttcttcctactctcctgcaccttctcctccttgagtcaaggcctccggatccactggatagctgagatcttttcttggagaaagacgctttcctctttactccagtccctcactccccacctgattttcctcctcttctgctggtcctgtctttttctactgcctctttattaatttcttgcttgtgtgcccctctgggactctcttgtacactttcctccatctccactactcaggatctgtgtgtgtgctgccttcctcctgtgtgctttctgtccccccatctctgtttgtctttcccacttctattgccaaagggagagatcctctccgggctgttccctggccttctgctcctccgggctctgtcccagcagcgacaatgagctccacactccactcggttttttcaccctgaaggtcagcatcctgctggggtccctgctggggctctgcctgggccttgattcatgggcctccccaaccagtgggcccgctacctccgctgggatgccagcacacgcaggacctgagtttccagttcaagaccaacgtctctacggggctgctcctctacctggatgaggcggcgtctgcgacttcctatgcctctccctggtggatggccgcgttcagctccgcttagcatggactgtgccgagactgccgtgctgtccaacaagcaggtgaatgacagcagctgcacttcctcatggtgagccgtgaccgcctgcgcacggtgctgatgcttgatggcgagggcagtctggggagctgcagccccagcggccctacatggatgtggtcagtgacttgttcctggtggagtccctactgacatacgaccttctgccctgacccttgatggagttcaggccatcccggcttcaaggggttaattctggatctcaagtatggaaactcggagcctcggcttctgggagccggggtgtccagatggatgccgagggaccctgtggtgagcgtccctgtgaaaaggtgggatctgctttctcctggacggccaccccacctgtgactgttctaccactggctaggtggcaagctctgctcagaaggtaagaccctctccctctcttgctagagacccacccagggatggctgaggctggggctcctgatacaaaccagttctatatggatgcatatctttactgcatgttagatcactgggccccttgccctaaggaggcagtggaaatcctttgcctaccttaatggagaatctgtcagatctcagcaggagtagaatcctgacccctgaaccctgggtctgtaccctactcagagggttagatgaagtaggctgcagggtctgccccagcttggccctctcactgcagcaccgtttatcacagtcaacccagggcaagaaatcagatagaaattggaatttcggctaggcaaggtggctcacacctgtaatcctagcactttgggaggccgaaggggcagatcacttgaggtcaggagttggagaccagcctggccaacatgatgaaaccctgctctactaaaaatacaaaaattagctgggcatggtggcgcacgcctgtagtcacagctatcgcaaggctgaggcaggataatcgctctaacctgggaggtggaggttgcagtgagctggaatgcaccactgcactccagcctgggtgacagagtgagactgtctcaaaaaagaaaaaaaaaaaaagaaaagaaattggcaaatttctacctgtgtctctcctgagcccttgaggttggacccttagggatagctgggaaactccccatcacttcctcttaatcatccctcacataagaatgcctgtgcaaagaaaaatgaacccagttcttctattggggcccaccccacctccaaccctctgggaggtgtctagaaggtggatgaggcatctgcgccaggcccttcttaccttttgtttttggcaatgaggatttctcacatgaggtacctctttagatgtggttccctttccatcctctccatgtactgagaacattgcaaagaggcacagagattgactgcagtgttgtcagccaagcctccaagggagctgagagtatacagcatagcctggagaacctcccaggtcaaccgtgacttcccagggagaagcagggaggcacagaggcttaggttgccctcccttgtcaccaaatctgactgtttgggattagatctaagagaggtggctcaaactttaacttgaaaatacttaaaatccaaattcctggacttactcacggcttagatttgggtagcaggaacgctgacatgagaagctgagaaccaaccatacaggtatgtatgttgagaggttagggtgaaggaggcaaggaagtcacatttccttctatccttttagggttaagccctggtttctcttgacgggttttatgttgccatcccctactggtctcttcgtggaggtggtgtaaggtataggcagaacagtggttctcaatttagctgcatgttaagattgtcttgggggaatttaaactcagaccacaccccaggctaattaaatcagaatctcttggcatgggatccaagcatttgttgtttttaaagctctccacataattcctgtgcacaatcaaggttaaggactaactagtaaagatcaagggaggccagatggctggtgccaggtgggtggtgccaggtgggtgtggccagtgagtgccttgccaccgattcccaagatctcttcattcagataaggccctgctattggatgtgtaattaaagactgcaggtgttccttaagtgtttccagaacatcccaacccctaagcaggttgtgcttgatgtgaaccttagctatcagtggctatttaagaatatttaaaaaattaaaacaaaatttatttcccaggtggtacctgctggagactggaacatatcagaggtctgtcatgcatgggctattgcaggagctgcctgggtctccactcctttcttctaatgggtgggcatcacaactttctcccttcctgtgggtgggctgtcagagctggagatgccaggcaatatatcgtccttatttggcttctgtttttcctccactgaacccactgggagaaggggtgggaagaggcaaccccagtctacaaaccattttgggaatgtggttattgaagtgcttctacaagcaggtgccttctggagctgactgctgttccagagcttcttggctttggagaaagtctgcctgaagacgctgacatgatcacttgttttctcattcgcccaaaggatctgttctttctcaaaacttgtattgaaagctggcattcttcctttctagggaccagggtgtttgcagtgtgttgttagcttgctgattatccctgattgcatttttgtgtttaaaaagaactcattccttggggcaggtttggatcagcacttttccgcaggaaaaaaaatctctatactgtattgtatacaatttgcttttctcttctttttctttttatattttgtgtgtgttccagctccagtggaatttcttcagagcagattgtgtgccattggttttttaatagctaaatgcaatagtatattttaataattgtttttttttcctacaaggttcagatcatctcctggctacggatgatacccctatctgtagaaggcaaacacacatcctaactcatttattctccccatacaaaatagagtaaataaactgccgtaacagtaacacttggctggcttggaacagagcagtgaaaggttgaggtgagagaggatgttgcgggaggtaacagaatctactgttgattacttgagcctgttgatcctggtaattgtcatcaagtctaatcaatcacaaaaatgcatcacagatattagaaaataaccgttgcctccacacatagttaatttttagaaagtaagcagaaaaatcacctgtaaaatgtgaagggaaaggaaatcacagcagctgctaagtgtcaaatagatcacacaaaacaagataatgtctgcccatttttccaaagataatgtggtgaagtgggtagaagaaatgcatccattctccccacccaacctctgctaaattgtccatgtcacagtactgaaccagggggcttattcccagcgggcagaatgtgcaccaagcacctcttgtctcaatttgagtctaggccctgctatttgatggtgtgaaggcttgcacctggcatggaaggtccgtttgtacttcttgctttagcagttcaaagagcagggagagctgcgagggcctctgcagcttcgatggatgtggtcagcttgttggaggcgccttctgtggtccattatctccagcccccctcggtgttgctgtttgcttggcttgtctggctctccatgccttgttggctccaaaatgtctcatgctgcaccccaggaagaatgtgcaggcccatctcttttatgtgctttgggctatttgattccccgttgggtatattccctaggtaagacccagaagacacaggaggtagttgcttgggagagtttggacctatgggtatgaggtaatagacacagtatcttctctttcatttgtgagactgttagctctggccgcggactgaattccacacagctcacttgggaaaactttatccaaaacatagtcacattgaacattgtggagaatgagggacagagaagaggccctagattgtacatctgggtgttatgtctataaatagaatgctttggtggtcaactagacttgttatgttgacatttagtcttgccttttcggtggtgatttaaaaattatgtatatcttgtttgaatatagtggagctatggtgtggcattttcatctggctttttgtttagctcagcccgtctgttatgggcagccttgaagctcagtagctaatgaagaggtatcctcactccctccaggagcggtcccctcacggctcattgagagtttgtcagcaccttgaaatgagtttaaactttttatttttaaaacattcttggttatgaatgtgcctatattgaattactgaacaacctttggttgtgaagaattgatttggtgctaaggtgtataaatttcaggaccagtgtctctgagagttcatttagcatgaagtcagcctgtggcaggttgggtggagccagggaacaatggaaagctttcatgggtggatctctactccaaatctacctatgtcacatatcactcatgccacacattttacgttgattcagtagagggaaaaggttctagtctactgacaaagaaaaagtgattacttgtcttctgtcttctcctgtggacttgagtgggtgcccagaccagaagcggttgtctcgatacttagctgttatgttttcaagtgttggaatcctctagtgaagtgtcgtgtgggtgttggtgatagggaccacagccttattataagcacaccgttgtgtggtcctcagagtgactagccaccgccccccgccccccccccccccacccgccacctcctgttgtctgagctcagatcctactcaggtcagtttgactgatggctcaacaccactgtgtggccttcgctgccttcctgaaagtgaatttcaatttctttttttttttattgagaatttatgactcttccccatctctcaaagccaagactaggatggaatggcatataccaagaggaggctgcttaccctgagcatttactgaggtccagagacatcagatactgtagtgaagggaccagtggttcctcagttggatcctcctgttttgggcacttgtgtaagaacccggtcatttcctctcccctccacagtgcacatgctgcttgaattataacatggcattgttcccaatctgtgtcagcctgaatggctttgagaaggggtgggtgtcctgcagggaagtggagcataatcagagagtaaggattactcctttctaagtcttccctggtttgggaaggagagaacagaagcagggcctaaaatgtacacaaaggagggactgctgcttctgagacttgattccccacccagcattcggttttccatgggaccagcctgactctccaccagcccagccagcaggggctgtcactaacggagcctgaataggggtctgattgctcctttttcctcctttcctcctgattaccaagtagatttcctgggtatactgtatgctaaatggcagagcagccgcctgccacttgcttcaatatccctcttttaactgctgagggaaaagcaattttttaaaatctcccccctcccctaaatctctgcctcctttaatgaaataagacccttcttccatgttcccccttcaatgaggtgaagcagccttctccttttgcagaaaccgcccaccagctgcaggctgcaaagagggtgggagtggataatgctttggtccaaattcagcaaggctgagggtcaggcagacattttgccagagcctcagagtagcacgtgaacttgcatttgcatttggtaatgagataccacaggaccatgccgggggctaattattttcaagacccctatctccatttgcaggctgctccagaaagtggtttccagtttctggggcagctgtccttcagctgggtcctctttctccttcacagggagatgaggtggggtgtgtgttgcaggctgcacttgggggatgggactaccatgacccccttacttgcagtcactggctccacagtatgggtccatcacagtgaggccccagaggcagactagagtaagggaggctttagggcagggctccaaaggtcgagtgcccttccttacacaaataataatgatattattaccattgctcttattaaataccaccctgcgcctgacattctagtgctttttatattcattggctcatctatttctcacaaaactcctatgaagttaataccttagctccattttacggatgaggaaaccgaggaaccgagaaattgggaacttgaacccccgtttggcatagtggataagagtatggctgctggagggaaaatgatccggacttaaattgggcttgtctacttacatgttgtatggctctggagaaggtttttgaagcttcagtatctctttagtaacaatgatagctaataatcacagagcactggctccaggctcacactgtcttggtgcttttcatgcactagctcttgaaaccctcgcaaccactcttgacatgcgattatgttctcatttttttggataaggaagctcggggcaagaggttaaataacttgcccaagatttgcaggtattaagaggcagagctgcaatttgtgtctagacagtctggcttcagagcctaactgtcaaccaccatgctatcttgactctcagtgaaacaggaatcataaaaaatcgtactcatggagttgttgaaaggatttaatgagataaaacatgaagttatctgcctagactccggaaagagcaagttctgactctgggctattggtttcctggcctgtgtaagaacaaactgacatcaatttggtttcacaggagatttgatgcttccttttgagcgacccctacctccacagtttcccttatcccagtctgaaaggtggtagagataaaaggaggggaattttggaagttacagaatccaatttcattccatttgctcctgcccaagagcatggggctgctgacaatgttatgactgcgggatgggattcagggctctgccggcaaacgtgtggtgttctggcctcacagccacccagtgaggcaggtagggcaggccttagcatcccactgaatagatgagacccgaccctgaacgtgtcatgggtgcaagggtatgagggcaagtgtgggtgctgcctttgggagccatctctaggacctgagagcccaggccctcaatgtggcattttacctctgcttctggctccctcaataaactcaaatggcctgtgtctctgtcgtgagatggagcattgcctcccggatgcggatgataagcaaaatgtcaagttcctggtgcaggaggttatcagcttggccttcccaggggctttgttccttctagccagagagagagagagagagagagagagggagaatggaaagaaaatgaaaatgaatgaatatgagtatagtattcaattcccagcctcaaaacttggttttagtgaagtgactgggattggacccaaggctccggaggtagttggagcacagggcaccacaccggagcttcgctggacaggatgacctcttcaaacttacctttggtttcccggtaccaggcaatgcccattacctcactcagggttggtggtgagagttggagctcctggttcctctgtcaaactcctcctaactttcctgccttcagcttctctctgcatgtaaaaaaaacaatctttctctgtttcttcttgtctattcctttgtgtgtgtgagagggggagatgatacagaggtggatttaccatgaaactaagcctttcgtacattctcagttgcacgggtccttctaagtctccacacctaattttgtatttgcaatttctttttcttaaggactcccaaaatcataagcaacaggtcccacctctgtggatccgcctctgttaacacaacttgttgctgccgtgacagcaatgttgctctgggtgtatgtgtgatttcatttttttcttctaaccagtaccattcatcacagacacattttctacttcataaccaccataggtggacgaatcagagcagggagtacaggagggtgcagggaatataggaatgtcatttgggaaggtgtggtgggaaaggagatgtctaggatatccactgggaaaagggaggaaatgtttggaaatatttgcagtgatttagaggaacaaggtggtatttagacagagggatcactctagtcatcctcctgaggttttttccctgctgaagttgggaggtttagtttgctgtggctcacaaggtaagggggagggggggtttgctgggaactgtgttgcaggtatcaggctgtggctggcagaggaggacaagtatggctctgcaggcctgtctccctggtctatttgggaactgacattgccagtgggtttcattattgctgttgttctccagaaattgatgtctttgagtgatctatttaaaaacaatcgggactccctttaaatgtgtcatcgtctatatccgctctcaaaccttgactgtggccaaatgttcctaaataatgtattttccaaagtttttttcttttttttttttttaaatcctgaactggtaccagtagcttttaaaagcaagctgacctcatagtcatccagagaaactaccagttgcactctgtgacaaaacttactttgcatctagtcctagaaattgtgaactctttgctctttgggggaaaaacagtgcaccatccaaaggtatgcaagggcataaagaaggtaaaatgaaagagagggagggacaagaactgtaggcaatgtaaagctcctggctcaagttttcggctgtgaaatgcatataggatccttttggttttactgagagccttatttaagtacggttctttgtagctaagaaaatgactctggggagttttcctttaagtttctcgatgagatgcattcatccgatcctctcctgacacttttgcctctgatctgctagcttggttctcttgaattgttctgtttgcccgtgtgaagtccttagaagacggagtcccaacagtcctgtggttgttgctggtaatgtaggactggtgtctccactgtagcaagcagtacatttcaggcaattcgcaatctctcctccaggtatgattggaaatgtgttgcctgcagctcttggagaatagaaaagtacagtgagagtgtgtacagcttatttacttaataggttgctttcaaatagaaagggtacccacttgcgaggagggatacgctggaaagcaaagctgagatcacttctttgtgatcacatcatggggaaagggctggacaggctgggagtttaccacacactcagtttcttcctcctcctcattctctcaggcttcttttctttccagacggggccctgtatcttgcatggttgccttgagagttaagagaatgggaaagagtgggcttgaagggcactgagctctgacctgggaatccttgaaagacaaatcctcccacagtatgtttgctctgtctgggccagaaaagaaaggctggagtttaggcagaggtgttgtacaatcacatgatgtgctttgactcacggctagttttaaggaaacacactgaaatttggggagattctggtgttgcaggagaagtctgtgaggatgaagtgtggatcatgtggccctgttagaggatgctaagacatttattataatgtttactttctagctgtgactttgccctaggtaatgtactggaaaccaaggtacattataagtatcatgggagtctgggcgctgtggctcacgcctgcaatcccagtactttgggaggctatgatggaggattgcttgagcccaggagtttgaggcctgcctgggcaacatagcgagactcatctgtacaaataattaaaaaaattagccaggcaaagtggtgcatgcctgtggtgccgctacttgggaagctgaggtgggaggatcgcttgaacccaggagataaaggctgcagtggctgaaatcacaccactgtactctagcctgggcaacagagtgagacccatctcagaaaaaaaagaaaaaaaccaatcatgggataataagtttaaaggggacttcaaaagtcattggactaagtactcatttctcatcctcctctgcactatataaaatgagcctccccgtgccccgccccccgcccaaagaaaacctgctagccatctgcaataatgggagcttggtgcttttcaggcagcctaatgtatctctggtcaatactgagtatcagggagctcttctttatatcagcccagccactttctcattggtcctcattctatttaaagtaatctgacctttgtaatgggcatgtgggtgaagaagatgggtgggttgattctaacagttctgaatgatgcttcgcaggattaacccttgtgccaaggtaaaattcttaagggattctctaatatggtgctagcagtaccataccactgagttatttagaattaactgcttatgattaatcttaaacagtgtgggaggcttgatgtgggaagagatttgatgtaagcaggtgactcatactccagtcattttgcttcggggagcttgcactgtgaaagattcatggttagccctatctctggctcttttgtcagtgctcattttatcaacctgtgatgtcccatcttcccccatacccaactaggtttttagcgttctgaatttccaaggagcttcctggaaatcctgaatttctctgcgacaaaaacatggggctggggacggtggctcatgcctgtaatcccagcactttgggaggccgaggcaggcagatacgaggtcaggacatcgaaatcatcctggccaacatggtgaaaccccatctctactaaaatacaaaaattagctgagtgtggtggcaggcacctgtaatcccagctacttgggaggctaggcaggagaatcatttgaacccagaggtggaggttgcagtgagccgagatcacgccacgcactccagcctgggtgacagagtgagactccatctccaaaaaaaaaaaaaaaagattgaagttctggaatacattggagaagatgaaaaggggattggattagacttgcctaacaagccatcatggtagccagagtcagacacaccaacagaaataaagatttcgctaaaaggcctgtagtattttttttcttttcttttctttcttttcttttttttaaaagataaggacatgaatgaagcagtattgagtagctgctcctggagacaggccttggaagcacattccctgtgcaaaatgcttcttactctgccaggttgctctgggtatctcatgtttttggcactgttgggagaagtctcccagggaaagggcttaggcagggctggaagatcttgctctcacattggcaagactggaagcctgccaagcaaattcgctcctgcaccctaaaggggatgaggctagtctggccgtcagccatctccccattgacagtcatttacctgacacagcagcagaaaaaaaaaaaaaaaaaaggaacccgtctcatcattttgtggtttaaaatagtttacttttaagagcaagcccacagacatcattttgagtccaagcactgaaatggaatgagagtcaccaactcgttgtggtttcattgtgcagccaggcctcggaccacacgcatgtgctgggaagtgggcgtgccacctcacaccatcatgtggtcattgccacgtgggcagaggatggttgggttttagttctgtggaaactttgctatttgctcttcctgatgttgagttttcagccttgtgttaacacgattggggctattttttcctcgtgtagaatatataaccagtggctacattttaatgtgttcttggctccctttggcttttctatccttaatgcaagttgcgattgctcaactgggtttctgattcctgtggcaggagtatgtgaggaggtattctctttaggaactgtaagacgtgaaccaagggtggaggactctgtttcccttagttaatgcacttacaggcttgtttgctaaagtcacgtctctgacaaaaagcaggtactcaataaatgtttgttgccttaatcacattgttgtatatgcaggttttatatgtgcacatatgtgtctgtattcatatatgtgtgtgcctggctccctaatgtgtggtggatggatgcaggttcccaggaatatgagctcaagtatatctttgaataaattaatcaatgaagtcaggtccaatcggaccacactggccactgttggaaaaccttctttcttttaatgggaaaagtgtcagttttattgtgggacagtttttgttgaattgtgtcaagcacatacacattccgcttggtttgatctagttgaggatgaactagaaatattttttttttggtttgtttacaaaccaatgatttcctataacaattataggcagtagccgcctgggaccatgtcaatgcagtggaatggctgtttgaggcaggcacgttgttgtcactgagatggagaggccccactcgctcatgtggattccctggggaagatggagctcactagaacaggataattatcctcagatattggaagtgctgccatgcaaaggaggatgatgatacatggcaggaaagccgaaggaatccgagccacagaggaagaattctctgttggttagaggtttggaccacagaacgcacaactttggcaagctctgttcccaaaaggggcacagcaggtgtttcgtgaagctatcaggagcatgtgccagcatgtgcatgccttcaatccaaggactcttggttttggggtcttggtagccaggcccaccctcatgtttgattatgcacatcatgcaccccttttagggggtgagaaagattattctctagatcagtggcctccaaatagggcacagccaagaccattctttggggatgcaggacctgacttcattgattaatttgttcaacagatacattgagctcatattcctaggaacctgcatccatgcaacacacgtaagttaacaatgcttgataactcatatgcaagtttttaaataagtaaatatacatctgttatgagagcgtagaaatttttctttctcatggggaatttgttcagagagggtgggaggccactgatcaacaccaaatctacctttatctctctttaattagttatagttactcctgactgcctgtagcaatccttatccccagggcttgcagctttcaggatcaggtgatacctaaggcattcctgctgcagtggtgtatgtgttgggctccttacttctgccttcagttctgcctgtggtggtcttgatgacctgccaggtggctctgagggcttcatggggagatactccagttacagttccttctcagaggcctcactctgttcaggattactaacgctatcatttttggtatgaaaaccatggatgaacatttgttggggcaacttcgttttgtgtaagagagcaaagtctctgaactatctcaagcttttgcaaagcaatccttgaagtataatcatctacttgttggaacaggccatcttttattggaataagtttattcacctgacattcactacatggatatctgtaatgtaccaggtgatccctgcccttaaggggcttatggtctagttgggaagcttgtcaggcaaagaagttatagcacatatcagagttgctctaatagcaggtagaatgtttgtaaagcagcttaaaaggagcatgttaccatacctgggtgtgggcgcgtgcctgtgcacttgaagtgagagttaggattggaggaaactttgcagagcaaattcttgggcaggacatggaagcattaattgggaactgggaggaaaggacatcagggcagctctatgagagagcagcttgctgtttccagctgttgcggtagtcaatgtggttggaccaaagaattgaggccaatgggatagtaacgagaggtgagttagggagggaatgtcttaactgctttgtagggattttggacattattttttccaaaccgggaaccattggaagtttttcagttgaattgtgacacagtcagatttgaattttaaaagatgactctagggccagtttgtacaatggattgatgataggaaggcttaaggagggagctagatagaagctattgtacggttttggtgagagaggagtctgtattaaggggtgggagtgatggaagaagggctgattgcagagatatcaaggagaggaacttaataattaggtataattttagttttggaatcagattgcctgtcacatactaaactgcaaatttgggcaaatatctcacttctctgtgtttccattttgccatctgtgaaatggggattataatagtgtgtccatttaggactattatgaggtttaaatgagatagtgcacgtagagtgctcaggacaatcttggcacatagtaaacccttagtgaatgttagccattattgtaattgaaaagagaaagcagagcttcaataatatgcccttctggttgtaggaatgtagaacaggaaagccattgtgggagcaggtttggggtgaagatgagagaggagtaaaaatagattttgatttggccgttacctgccttccttgcagatcctataggacccttgtcgggagatgtacaggggcaggtggggcaatggttggcattggcggggggaggatgggggctgccacaagtttcagggtggttgtgtggtgggaaagacttggatgtggatgaggctgcctagggaaggaatgtggtttagaggaaaggagcctaaatgtagaaactttgggaactgtaatatttaggatcgtgggggaaaggatccataagatagactatagcagatacccagacatgtagaaggaaactaggagtgaaagaaattctttaaaattcttcactggtgaataaatgaaagagtgtaccttcttaaccttctgaagttggggcttgcagttgaaaattacaataaaatgatgaagaattgcattgtttagttcaaaaactattcatgttggtttttcttctaccttcaatgtagtgaggtctgttcatttagaacattcctggccgggcgcggtggctcacacctgtaatcccagcactttgggaggctaggtgggcaaatcacaaggtcaggagtttgagaccagcctggccaacatagtgaaacacgtttctactaaaaacacaaaaaattagctgggcgtggtggcgggtgcctgtaatcccagtacttgggaggctgaggcaggagaatcacttgaacctgggaggtggaggttgcagtgagcaagatcgtgctactgcactccagcctgggcgacagtgcgagactccatctcaaaaaaaaaaaaaagaaagaaaaaaagaaacaatcctacaagtagaaacttaagtctcatatgcgggatgacgaacctgagggttttgaatgtttttgcacatgacagagtttctggctcttagacatcaggtcccataagagcaagaactcaaagatctgaaagaaacaaacgcagagaaatgagtgacttacccaagatcagcaaactggtattctaatttgaaccttgcacttttttgagccacgtgagttaaacatgattaaacatgaaatgctttggctaagtttttctgagggtctgcgtagaactcttgggggtgccagtgctaaagctcccctcaaagccatatacctctaggatcgagggaagaaattctcctacctctggtctctgtgggctgaaagagtgagatgcccaacaagagatgctggaagccctggctcagctagcaatataagtgctggtaattaattcactgtggtttctttatctctgcccagaggtgggatgcttggaaagacagcaaaataatttaggaaattgaggctcagctctggttgcctgcttgctgcccttccttctgccttcaactcttaggactgggggtgggggctgtgtctgtgctctgaatgcttgctgtgcatcagttttccggaatttcaggacacaggaattatcacccagctgtgttgtgtgttgctgttcagcaatcgaagttgcttatctagcgtaagtcagaacggggagcctagggaggaggggcaacgccttatttttctaagcagaagagactgaggtgttaggggcccagctggtatgcgatgggaaccagaaatggagcctatgtggacatgcatgctttacacaaattctctcgctgaaactcgggatgttatcagaaagctatctctttccacctcatccaacaacaatgcacactatttgaggtcactgtgtgtcaggagaagcactggtggtaagactggtgagcaagacaggcacatcctcagcttaattaaccaagcaattatagagtggtgtatgcattaaaggagacatatgtgtacagtggtctctatgggtttattggtctctcttcacatatggcagagaaaagaccctgtgagttcaggagtgtgattaaggtactccaagaagtcacacacaggaggtccagggcttttctggactcactgttcttggactggctctcctagcctgggtctgttggctgaggaccacaatgaagccagcagacttaggacttacgcttctaagtttagtgcccagctctaatcatgccctgagtaggccttgatgatgcattttaatttcatccaagttgaaatggtttggctctggtccccagccaaatctcattgtagctcccataattcccacatgttgtggaagggagccgtgggagataattgaatcatgggggcaggtctttcccatgctattgtcatgatagtgaatagtcccccaagatctgatggttttaaaaacgggagtttccctgcaaatgatctcttctctgtctgctgccatgtgagatgtgcctttcaccttccaccatgattatgaggcctccccaccatgtggaactgtaagtccaataaacttctttcttttgtaaattgcccattctcgggttgtctttatcagcagcttaagagtagactaatacacaagtcttatgatttattccttctattttgattgggtaaatttaataataatgacagttaactaattctcatgaagcacttacatgtgctggggactggcctaagtatgttcatgtgtgacttctttcattctcccaatcgctccacccaggaaggaggtggtggttgtcctggctttacagatgaggaaactgtagctgagagagaaagcatctgtctaaggaaagagcccaggcagtggatgtggaatttgagctcttactcatctctctctctcaccccctattcaatctggcattgaatgggggcgggggggctctgtggatatcagtgactgaaccttgtcctcggctggcccagctggggggtctctagcatcaaagacactgccagtattcattgacctgtcttttgaccttctccctctcctgcacatactgattttgctctgctctgatcctgattcagacacatgttcttcaaagagaaacatacagctgccctggactgctttttattctgttgtcttattccatctcattggccatcattgagtggatctagaacgatgcttgggctggaatcgcatattctctccatcttttaaaatctatacctccaggtaatctttgttactgtttttgttagtctgttgtccaccactatccaaaagctttttgtcaagatttagtgaaaatcttttacttgtattaaattgtaaagtgaatattattcaattacattgtaaagtgaatattatttcaatttatatatttccccaactcatgcatttattgctttaccccttccccctcttaagcatcacaatccaacctccttttatgaaactacttagggaggcaaggtgacttacaatgggccactcaggtagcaagtggcttgggactggactagaactcaaatatcctaactcccagcctagcactcattctcctacatcactctgaaaaagattttggctaaggagaattgattgattcaaaagaacatcaattgccaagcacaacaggggtgatcaaaacagttatggcgcctgtctgcaatgaacttacaaatgagtggatttttttatggaaaacataaaccaataagtgtgtaattacttgtgatgagtgctgtagatgaaagaacagagtgaggggaaatctaatgaaaaccagggtagtcagggaggtgtttctgagaggtgacatccaaagatgagaaggagcaggggagaaagccaggcagcggggctgtatggttcattgtcatttgcttggctgaagaacaagattggttagtttgatatcgttggccagactatgtctttcacttttatgtatttgcttggagtatggttgatgggtagtgatggatgatggatagacggatgggtggaggactgactggggttggggaaagagagaagccatcagttgataggatgagggcagctcaccttggctggtaagtggacacacacatggccctctcctccagaatgcagaatcttggaggtaaggattcaggggtagaatgtctatgtaaaggaagcctgttgtgggagaagggtaaaaatgaagggctgctgggactagaaagcaataatgtaattgccaccagccttgagaaacttattgctcgaatagctgcaccgtgtggctcccacccatgtgccatagatcagcctgaaaattcccaaatagcttctcctcctccttaatgtctcagtctgccctcccaggtcctcccacctgccacagtttgttttctcggtacatgaagagaaagggttgttgtcttgatagatctctgctcttcagctgttgttgccagggacatttatgttcagaacatctaaaaggttctcaacttagaggagtagtggaaaatctgaggctggggagtcgcctgattcttgatgggccattcttccttgattttaggctagcatctattgacctcttatacgtttcgggcactgtgaatagcttcaccttttattcccattttacagatgaggagacgaagcacagagacttcccgatctaccctccacccagtagtacaaagatacacaaggcgcagagtgaagtttttccatcctgcatgaaaacaataaaaataaacaatgtagtacattttggtgaagtcactttttttttttagtttatgggatatgcccttttattttggggatgtgaaagaccttttctttttaagagaatatgatgatataaagtgtcagtttttagtttttgtttttcttggtagtagagaaatacagttagccaatgttagtttccaaaattgctttaaataattagaggtaaataaactctgttaatctgaagatgactgttgcagatgttagcttcgttcctttaggagtaaagtatttgtatgattttatccactttttattctgatcatttatcagaaaaattgcaaatagtagctctgagaccatataatttatttttattcagcattaatcaaatactttgattgtacagttttgaccctgaggccctttacctctatgttggcataatcggattagacaaagactgcagcatttttatcaatggagtatttttcagaagcaaacagtacggggtcatataattcctcgattcattttttcttcagcacagttaaaccattccttatttttcaattcagttttatcttactgaattatttttaacaagatcaattctgctccatatgtatctatagtgaagatttgattcatcaatcagttatttttcgtgtgcctatcaaattttacgacacggcttctactattgtgaatgttcttttgtggccattatttctgccacatccaatttctcacatcagatttgcaggtctaaattttgtcaagaatgtttgatccttccttcaatttttagttaataacaaatttcaccatgcgcatttttagctgctgtcagttctatttttttgtgtgtgtgtgtgtgtgtgtgtgtgtgtgtgtgtgtgtgtgttttcctgacaggtctatttttttccgggtcagtttttgcagtttgaaaaaccaaatcttcttcctacaactaacgcagtccctttcctaatagtttctcaggaatgtgtccaaaacatattcatgaagtcaaaagtcaggaccaaaatagcctgtgttgtttatagagaccagccactcagaaggattaagaacttacccgaggtcatacataaagtgggcagcagatatctgttgggtcactatagaatctcagcccctcttgttcagtgaggggcagagtaaggatgtaaaattgggatgagcttgacgtgtgccttcctccttctagcttctgcttcccaacccctctgctgagctaacagaatttcactgacccagcctccccaagaaatggcagctggggccacagttccaagcctcttgactttccatgcttcctagctaggtccgccttaagctgtatgtgcagtggggtggcatgatttaaaataagcaggaccaaaaaggaaaaatcctctcttgtggaaaattaggtcagtggcagattggggaggggagggaatctgggccctgttcttctatcctttggttcattcccctttccgaagccagcagggcagaaactgatggtgctgttgggagcagacatctgggggtgaggggtggggagcagtgcccgttcacgtgttcttgtgtggatatgtgtgagcatgaaagtggtcgttttgcagccacttgggactcccctctctctgaatgtatttgtctggattactctaaggggatattagtgttgtctaataacggccttagatttatcaggggatttgtttgattaatccaaagcaaagtacagcagatagattagagctcagccagtgtagtgggtctataccaccatctctgccctttctaattcctgttgcgggggcttccctctctcgtctttgttgtcttgtggttgaaggctctagtgtttaagaccccactgtgtgatagttaaaaccatttcccactctaaaatgcatgagtgagtgtctgggcttagagataaatctccaagttcacactgttgttctctacaaaagctgcagaaatttggctacttgcttttctttcccagttgccactgccgactctttttctgaatactaaaaatgttttattgcatttataaacacaagcttttggtgaaggttggcactgagtcttttctttattgggaagttgtaggtcaggggcaggagtagagatcctgtatgtttgctttacaattttttttcaaggtgcacctgtttaaaagtgtgtagagggaatgaactaggggaggttagaagtaggttagacttaataggtttttgttaagttaccaaaaccagtggtggtaggtggcatcctggtgcctgctagagttgtggagaggggagaggcactgatgaggtgacgagacagatgatatattaagagttagcaataaaacacatttgtaggcattttatatttttaaagcatttttatatacattatctcatttgagtatcagcccccaaaatatattcttctatttaatataaaagaaatactggcacaaagagttcaaggtcattaatgaactagtgacttttagaactgaaaccacctctaaatccagtgcttgctctcaccaactcttaatgttggattcttctcccagactcccagtccagggtaccagtaccccagcagggcacagtgggaaaagcaatgacctgggatgcagatgacctcaattctgatttcagctcaaaattgtccagctgagtgtacgtgttaattcctctctcttggatctgtgtttcctctttgtgcctaaaagtgtcctggacaactctacagcactgatcacaatgataattaattagtgcttgtctgattatttgtggcccatcttcctggctagactctaagttccaagagtgcaaacctgtgtctgtcttgttcatctgccatcaccccagtgcctagcaccatccctgggacaagataatgtgaaaagaatatatgtcaatgaaatgaacctgtacaatgaaaggaatggacttacttgaagtcctaagactcttccacttttcaaattctctgctttttctctgttatcttgaaacaatctgagaaacacctcctttttttgtttttactgtttttaaactgtctttaggtacaacagaaattataagataaaaatagtgattaataataattctaattataattcacaacatattattaatatgtgaatgtgaaatcgaaatgctttttagggactctctc

SEQ ID NO: 5025 - DNA, 16700 bp, Homo sapiens
gggggcagttccaggaggagtgggaagacagaggggctggggcacaggttccccgggaccacttgtagtctgcagctcttcccacctgggtccttccctctatggggtaaatagctgaaggacagatagatcacaggtcatcttgtggagactgaggcctcaatagcctggcagatgcagtgttgggttggggcgcagctcaccagatatccctccccatggaatagtggcaatcactcagtccagaaacaagatattggcagctgaacctgccctaggaccccttgagtgctcagtgctgtctgggtaagtgctgagtaagtctggaaatccagactggggtctcagtactaacatgagattaaaggtcaagaaggctgggcatggcagctcacgcctgtaatcccagctcttgggaggctgaggcaggaggatcacttgagcccaggagtttgagaccagcctgggcaactcattgctaccaaaaaacaaaaaaattagccaggcatggtggcatgcacctgtggccccgctacttgggaggctgaggcaggaggattgcgtgagctcaggagttcgaggctgcagtggccatgatcgcgccagtgcactgcactccggcctgggtgacagagcaagaccctgtctcaaaaaaaaaaaagtcaagagaaactagaaactagtgcattatgcatcctgctgtatcccagaatattctcattcatgagataggtcgttttatctccattttgtatgagattccaagaattaagtgacttgcccaaagtcacacaaggaatgaagcctagattctaagtctacctagttccctcctctggccttttttttctttttttctctttttttttctttttgagacagagttcactctgtcccccaggctggagtgcagttgtgcgatctcagctcactgcaacctccgctcacgggttcaagcgattcttctgcctcagcctcctgagtagctgtgattataggcacggctaccaggcctggctgatttttttttttttttttttttttagatggagtttcactcttttgcccaggctggagtgcagtggcacgatctcggctcactgcaacctctgcctccaggtcaagcgattctcctgcctcagccacccgagcagctgggattacagacatgcgccactacctcagctaatgttgtagttttagtagagatggggtttctccatgttggtcaggctggtctgagctcctgacctcaggtgatctgcccgccttggccttccaaagtgccgggattacagtgtgagccatcgtgcctggccaatttttgtatttttagtagagacagagtttcgccatgtggccaggctggtctcgaacacctgacctcaggtgatccacccgccttggcctcccaaatgttaggattacaggcgtgaaccaccgtgcccagccacttactccctcttgatccttacttatagtaagcaacctcagctgagagctaagagtaggacctggaagccagacatgagtcgagactcaggtactcaaattcttctcccaccctgggagacagtctcctcctgcaacagagatggccctagcctaacgggagagtctgggatgcctatgcacagtggggaggaatggatggtggatttagagtgttcagtgatagggggtccaagcaagaagagcttttggaaaaagggctcaccctgtgggagagtggtcttcccacaggctgatcttggctgtgatgggcataaaattagtaacacacagaattctatttgaatttcagttcaactatttgttatgtacttttagcaggttttctgtctgttttccctttctaatggaggcaaaaccaccccccctacatagattcagtaagtaccagtaacatgctggtacatacatggtaggtactgaatacacgctcttccgttacctcccttgctaggctgtttgaccagccccagcccactcactggagcttgtggatcgttcaaatccagcggccacatactgccctctgttcttcaagtctgccaggttggtgcagggtggccatgacaaggtgtgtagagggcacgcacagccagtggggcctgcacagctatgtcacctcgcagaggaaggcctccatggtggggaagcggcgttgagtcaccaccagcgggagcctgggaagaatgggtccccattccggtacaccactaccctcttggctgctggatgccacctgccatagtgtatcctcagtcagagaaacagacctgttgccaggcaaccaagaagggctgggaacattgccaatcagaggtggagtcctgccctctcacccaggaaggcaggggagactgtggcaggagcatttatctgcattcagggttttatcccatctgccctgggggatcacacttaaacataggtgttaccctactctccagagcctccttgccactctaaagccaaggctgagctcaattggggatcagctttgggagctgttccctaaggaggatggctagtcttttcctgggccatggctcccagctggctccggggtcaatgccccatgccagtaggagtgaacggcagggcccagaatctgtcctggccagaagcagaaatgaaagcagccagactagaatctaagaaaaacctttattcccaacagacctctcattctacttcccccaggtaacccttagccacacatttgttttttgagaccgtgtctcgctctgtagcccaggctggagtgagtggcatcatcttggcctactgcaatctccatctcctgggttcaagcgattctcctgttcagcctcccgagtaactgggactacaggcatgcaccaccacgcctggctaatttttattttttagttgagatggggtttcatttcaccatgttggtcaggctggtctcaaacttctgcctcaggtgatccactcaccttggcctcccaaagtgctgggattacaggtgtgagccacgcacccggccccttatccacaaatttggattgagctacaggcagaggattgaaaatgtgccttcctccttccctatactcatgccagctctctgctccagcttctcttggccccactatcaccaatggccaggggcaggagcagaagccagagctggtcagggaggtaggatgaggtttgtctcactgccctttcatagcattcccctttggaacctgatcctctcctggcttcctgggtctagccaggtggttctgttttccatggcctgcccctccactgttcctctcctgtaagcctgcctttgtagaagacagaatctcaggtgactttgatctccatggtatagtcctcgctttttctgtccttcatgactaggctcattggaggttccatctctggagcttctatcatgggggcctggcctttgggtggtttagtcctccagagatcgaggacactatgctctggccccccaaggtaccatcccagatgatgtggtcctctgagaggcccaactcttgtgtcctgctgttcggcagtcaggctctttgtggtctagttttctgggagacatctccttaatatttagtcctcatagagtgcagacagctgtgtcctggacttcctgggacaatggttcctaggtttaaacctctgggggtctggtcctccaggattttcatctgcagcaggcaggtccctccaaggtctgtcttccatcgtctggccctttggtgagcctgtcccccaaggcctggctgtttatggtatagacgacggtggtccagacttgctgtagcatggttctctgcacttagccccacaatgtttttttgtgtagtggccaaacttcctggggatctgtggggtgatttgaccctggacaggagtcatcctcctgttctagctctccagtggtcctgtctctgtaggactggtccccagtggtgcgcttggttgtgactggtccctctcacaggcctgttccccatgttctaggacacgcggggttcctctctgatcgggcccgcctctggggatctcagtgtttgtttaagagtaggtactgttgggggagagaacatacattgtaccaagcaggcctgcttgggcatggcggtcgtctctccctaacccccacccttgaccctaaatgttcagaaagagttccaggttatgttacctccttacggctattgatggcctgttgcagccacagcaattccatggccaagtgctgcggtggtactgaagctcttgaagctgaggttggctgtggggcagtctttgatctgggcttctgtgaaggagggaagaaaggaaggagaaaaccttgagggaccagaccctgggaatggcctagccttagactttggaaactccctcccctgcactgcccaaccatgtggtggcctatcccggcagagggaagacgggaaagggatgcagcttatctagcgcaagcctttcaccttcagatgggaggctgaggcacagtgagggtcaggggcttgccctgatctttgcagagggtacctggattctccatccttgtcgtgtctctggtcttctcttggctgggtttcctgtctgcttcatctgaagccaggagctgtgatctctgcagaggcttccttgatttgctgagcctctcctgacttcttcagcaccatctcctcccaggtggcctctccctcagactcttcactgggaagtggttccacagcccctgctctggatttgctaccctgtctcctgctttccaggctgatgggattttgccttctgagaaacaagagagatgtgagagccccagggctaaaccctccaagtatctgggcaccatgatctagcagacaagttggtgagggttaaggagtggggttgaggaggtgagtctactgcctcttccagtgagaaaagcttatcactgggaagggtgggtccaccctgcccaagtccctccttcccttctctcctaggtgtgttctacctctgggaggatcgcggcctgggaatgcggccctcggtccactgaagcgtgcccaggtcgccctcgaccctcgtacaatcgcctcatactcagctcgcaggctctggaactggcgtcggaccaagaagcccggacgcaggcctggtatggagaacgagaggaaagaagtcccttatcacggtaagaggggggcatctcggaggactgtcctgaagaggtcgtcccggcgaatgcaagaggggacctacggcggggaaaggataggtgggctgtgcgctagggctccggggggctcgagggacgatccagactggatgcccctcctcgccttaaggctcttcccgtttccctgatccggcgcgaggtgtggtgggagtggggacgcgcagggcagggagtccgtgggtcccagctttcctcagccggttggggacagccggtatctccagaggttggcgcgcagttaggggactgaacgtggtgcatctcgctgggaggtccaggtacgagaccccatgatttccctaaaggaaaaatcctggaaccccgcgcccgcccccgcacctgcaatgcagacaccttccgaaccagcagctctggtccatgggcgccaactgccaggcccgcccgcgcgcctgcgaagtacgtcattggtcggctcgctcctgagcatgcgcgggcgtgggctttgccccagccgttcccacggcaacctcctccgtccagggtagaggcgtcctggcgacaggcgtacctgcgtccccccagcccccgactcccctcccacagccgcaaggggcactccaatcccgcaggcggtacctccataaccgaggctgtctccgcggagaccgggaggaaaggcgcaaggaggggaagcaggacacggagccgctgctttctttctggtttaattccattcaacgcccccctcccccatagcacctggggggcgcagaacacccgcccgagtctgtaaaaagtcacagtttgaagagaatgagaggggcagttgggcctgcgtgggacgcctacgcagcggactgctcctcaggctcggcgttctcggccagtgcagcttctggctgtgcccgtcaaggatcgtggcgctttggaccagtccttcctcccccccggtctcccatcttgcacaggtttagttccctcacctgtgcaaagggccggggacggggtctcgggccgtctgtggactgaggttgcagtccccgcctgccctctctcacccccttctcttcatccagatcgtgcaggtcagacacactggggtgtgtgcgcgcgcactcgcgcgtttctgactgaggaccaggtgaggtggtagtgtaaattagtaaaaataattgttcaatctgaaaggataggaggacatcggacaagctttgctatgattgatgtcagctaaagtactacaaagattttgatcagtagtaaaacatcccctacaaccacttttcttctaattttgggaaattctaaattcctgtacctgggtttgggcagtctgtggctaaatctgacaggactgcagaggtggggaagttggttgtgtgtgaatactcctggagggctggagaggaggaaactgcctctcaggaacacacacacatagacgggttccttggaaaggatacatagaattactgagtcttccagctgccaacaaagagaaaaagggaggcttctgttaggaggggaaccaggccaatccccaatgctctgggggctatcttctggggaggttgaggggcccagagctcttggaccatgcactcccaccttttcacccagggcccaggaatggctttgggagtatgtaccttcccacccctcatgcccccaggaaccaaagcacccagacatgaacccacattgctaagcagtggtccaggttacggtcagccattgtcttcttctgctcctctggcagcccctcagtgacccatcctcttcctcttcatcgtcctcctcctccccacacacatccaggctgaagtgcagcgggctagcttctcctgcatctcccgaacgtgctccagctgctcaaaggagcattccttcctggaacgaagcccctgtctgaaccctgggaaagagtcctggaaccctggaaccctggaccatggtcccagccatgccccatggactgggccctacagccctatccacacacccgctaaaccagcccccaggactcaccgaaggcctgcagccggccagagtggaaatcattgagcggttcaggagtcccccctccatctcatagacatcagtcacctcggtcaggaaggagtgcgcaggggcgtgcctgcagagccgcttccacctccagccaggactgggcggcacttctcttgcctactctgggtggggtggacatgaccatgatcacagggtagggggcagtcaggcactcccgatcttttgtgccatctgcctatgcaccagtttatctgtctatctgcactaactctctgcccatctacttactagcataaatgggtaactttatggttccccttgggcactgggaggggtgaggaggcgtgaagaggtcaaaaagaagtcttttctgctaataacacagccaggcagtgcctgaaagggggtccctgggttcctgtctgagtgcctcactcatttgttttataccctgaatgagtcacttatcctccctagtcttcagcgtatatagagacagctactccctattgccaccagggctgtcttacctcctcccaaaatatctttctgcccctcttcttttttttgttttttgagacagagtctcgctctgttgcccaggctggagtgcagtggtgtgatccggctcactgcaacctcgcctcctgggttcaagtgattctcttgcctcagcctcccaagtgctggcattatgggcgcctgccactatgccctgctaattttttttacttttagtagagtggggtttcaccgtgttggccaggctggtcttgaactcctgacctcaggtcatctgccttcttggccttccacagtgctaggattacaggcctgagccactgcccctagccctcttcttttttttaattaaaaaaaaaattttttttttgtttgagacagagtctcactgtcacacagctggagtgcagtggcacaatctcggttcactgcaacctctgccttccaggttcaagtgttcttgtgcctcagcctcccaagttgctgggattataggcacccaccatcacgcctggcaacttttgtatttttaacagagatgaggtttcaccatgttgaccaagctggtctcaaactctgacctcaggtgatctgcctgcctcagcgtccccaagtgctgggattataggctgagcaccatgcccagccaaccctcttctatttaaaaactcttttaaacaaaaacaaaaatactagaaaacaaagccaaaccaataaaccaaaaaaactgtcttaaaatttccactgctctcggataaaattgaatgcccctgccagcctggccctcctgccttcccagttgcctttcctgtactctccccacagccttgagcttcatgccccttaggcaagtggtgtgcaaaaccaggggaaacacagtggtcttatctggagcaactggagaaagaatacattgtatttagtggggacaaacatggacacattataaggcagcatgcaaactcccaatcataaaaaaaattcaacaagaattcaaattgtgcccccaggtatttcctcaccatttcctgttccctgatactccaggcccccaaaccacctgtggttcctgaaacctttcaggtaatagctttcttccatatttaaccaggtaagcctctcagcgtggaacattcactttcttgcagagttgctcactccctccctgaggcgaatcctcacgctatgtgatcccagtgacccacctggcctttttgccacacattgagggtagggactgggtctgagtgagctctgagttctcaggggtctgctccagaaagcatcaattattgcttaggaactaaaggcggaggccccccttgccttcctctctacagtgaacccagagttggggtccctcctcctttccttcccttctgtacccacctcttgaacttgcccgctgcttgggggatggcagatgaggaagtcctagggccaaggagccgctgtggctgtaggcacagggaccctccgtagtgtgcctggggcctgggctggctgggccaggcagggctgggactccgtttcttctttttgtcatccattgggcgctggctgggcctcaggcctagggggaagcaaccccacaaagatagccaggggcaaagttagcccttcacccagaaatccctagagctgcaccaaggaagggccctgggaccttccagcttgtcacctcatctatacggtagggcagagccagatgccagtgtctgctgctgggatcgtggatgtacacttgaaggacctctaaggcccaacctaattccccttctgcctgaaaacctaggcccctcctgaaagggtggaccagtcacaactatcttggcgctactggggcttcctgtcacggtggctggggggcgggctggcagaggaaatgtagtgggagacaagacggaggtgagctgcagaagcccagccgaaattagggatgtcttaactaaaccctattctatttatcaggggcctaagcagatgctaacaaccctgtcagcatgggagggggacaaggtgcaggtaggggcgcctgggaaagccccaggtgtgggtaattgtaggagaagccgcagcatacagggcagggttcattgtgggtttccccacatagacaccggcatccctccacttccacccacccccaaccgaaaatattagggactcctataggtcccgcgggtgtgctttcagctgcttcatttttcccagtcggaaagtccctctgggcttcagctgcagccagggtggactgggtggttggccgctggctgcctgggcctcgacaaaggctgcgcctgtggctgggctgctccgaggtccccggtccagcagcgccccccagcctccggtcggctggggttccctcctctgggggtctcattccaggctgctgctaccggcctaacttcgaattctgggactgggggggttgggggggtgggtggcgcttaagcatttcactgacacatagctggctgccactgacggggtctgcgggtgtggggaggggagatagggcgcatcctctgcctctccgtgcagcagcttgacccaattagggacctgatagaagaacggagccggagcctgtgctccccaggagcggctggggcgaccggggatctatttcccaagccgggctccaaagccatgtgccaaactcatcgctcagctccgcagccgcgctcgaagacgagcgtcagacccgcgtcattccgcccccgccctcactccctcagggggctactgacctgaggtttggggtctcgagtgatgcttcggtgcaagttccctccgccctccgccctctcccccgggaacaccaccgggtgaaagctaagctggagggagttcatttgcatttaaagagaagtgaccttctccttagcgcggtggggtgagatgggaggagcatccccgcgtatgctaacagttcctctcactcgacctcacctccccgcctgaacctaggggaccctgttggttgtggatgtctattttaaaaagattttccctttcccggcagtttcagagagaagctacagttcttacaaaatggtggtggctttgtcagaaagggggtggggcgggggagaggagagacagatgagtgagtgagagagagagaatgtaagcacagaagaagcacaagcagcaacagcagcacatcaggaagacacttcgagcaaagacagccatcaatggagtgagtccagtgccctattagcactttacatacatttcatccccataacaacccttaaggaagataccagtgtcattcccattctactgaaagtaagcaacagtcttttgagggcaaaacccctctctctacaatgcagacagttttctctggtaagtggtgggggctgtattttgccgcagatgaagtgacaggatcctccccaccccccaggcctaggagacaggtgtggggagcaccaggtcataaggtagacacgcgattccctggcacctgactccagtcctcagggaaacctgagcacctgatggaggtgacccagtgtgactgctgctgcctgcagccagatcaatgggggcagctatttaaagcctggcagaggctcctggcgcaggtccccagaacagcatctgatacaacaggagagaggctatgtttggccaggcggctcagcaggctcaagtgagctggcccagggcagtgcacacagcacccagcccaccttccccatccccgggcaggagtggcttcctggggttgggcctcttggtgatgtggggagccatgggcactgctcctgagggcacctgctcagggcttcttcctgggacttccaacactcagaacactccacaagggtaaagagtaattccgaactttttcaataacaggggcccagactggggacaacagaaatccctctccttccccaccggagctgctagagagacagtggtaatgctgctgacagagggagcacccctgtggttcccatcctcagctgctcactggggggtcagaaacctcattattctcagagctgctttgcttggaatctccaagagtggggcggcaccccccccacaccctccagaggatctgcgactagaaataacatggccagatggaaaacatgtatcaggacccagctagaagggtcagaggctctgctgggactgtcacgtcattgtgggcacatctatttgtggaggcctggagggaagggcaggtgggttgtctctccatttcctgggcattcagcacatatcatcctttgtgcctgaccaacccaggacccagaagaacagggtgctgggtgaggccaccagcagcatgtctcccatataggagtcccatgctgaggtgggtaaatggggggtgtaaaaactgaacagagaatgtgctctccttaaggaatgatacaattagaggcccctgtgaattcccttgggcaggccagggctataggagcctaccccagctcagacccaaatagcagtgatgagtgtccacccctcttaacctgggcctcaaatgcctatgcctggctccatgccttttgccttactgctggagcctatcaatttcctattgaacaccttcagttgccccccctgccctctggatctagcccacattccttaacctggtacccgactctgggcccagcctcaccccctctcccagtcccatggacctgcttcccagctgtacatttaatcactaaatgacgttcatcttctacctgccctgtggttcagaaggccattccagtatcaccccctcaccttgctgaagggggcaggggcctcctctctgctctcagcaccatgacctgtctatagctaaaagtaccttttcccttcactagcctgtgagcccccaggtcaggaaaacttttttgtgtgtgtgtgatcctctctgaggcaagggtcttgccaactttgccagggctccactcaggcagctcaagtgaatatgccagcatcctgaggctgtggcgactgctaaagacactgtggaatatgtaagataccagggaaccaccatgggcgctctgcagcagactgaacaagtcagtgatgatggaaggggctgaatggatcagatccagaaacaaaggaataacaggtcaggagagaaacaagtaaggcaacagactctttatttaatgtggtttaaaataatcaaaatcaagtccctggctgttgtgaatacccaaaggagacaaaaaagctgccagtgagcttcaaacaagtctgagtggccgggctgggccataaggaaagcagttacagggacagaggcagctcccttcccccaggaagggcaagaggagcaggtgcctggctgtccctggggtaccacctctgtgctgtgcaaggcggaaaggctggggcagcagctggagaatcagctcagaggccttggccctcccccgtggacaccaggcagctccactggcctccgggtcagccctcgggccaccgtgatggggtggaggagggttaaataaccatctttacagaaataacagtctctacagaaagtgcctgagctcagcccatggtccgataacctcatggaaaacaaacaacaataaaaaaaaaaagtgctgctgacacctctcagaatctggtggacatgaagctctcagcggacaaggccctgaaaacaatttactattagcagagccatgcgctcttgagcttcacctctgtggtcccctggaggaaaagctagcaatctaagaaaccaacacagatcttggtcctaaactgaggtcacaagtgtgggacccacccaggtgaggaagacactggccttcactcatgataggcacctcccctgcatctggcccaggacctgggctactttggaaagcagaagcagacagctgtagtgattggttgatttggtcaatgaagagaagaaaaaggtagggaacctcattgcagactggcctgaaggtctagacatggatggagctgtgagcaaaggctgcaccttgctggggcccacattcctgacctgggaaacccagctggggccacctgctcactgtggcctctacaccaccacactgggatccagcagctccagtccctccacaggcattaagaggtagctaagtgtgagtcaggcaattatgtgggccactgtaggcctttcccctctcttcaagggggaggtgcatacctctgcctcttccctgcacctctctcgcctagcaaacactctgtgaggtggcagctcttgtaccagcttagcctggcacaggggctggggtagggaaaaggccctactgagcaggaagaggcaaggactactccagacagagggattcaaaggggaagaaaaaggtctgggaaacacttcacaggacagcagtatctcagccagagatggcagagatctcaacactacacagctgcttgagggcacctagatgtgaaggatacaccagagaatagcaggcaactcgatgcagatcagtggtacctgccctggggcaggagaaggagaaatggtgtgccattcattgccatctctggtctcagtcacacatgattcagtacttaacattctttgtgaaccaactatctgagagatttaaggtaagggctaaaagagtgggctaggtatggaagatgaagggactgcaggacaatgaactagcttcaaagaaaaacagcaagaagcaaagccctaaccatccttccatcttggtctgagtcattctgttgtcccagaaaactgcttggcacaaacactggctataccctggcaagtttgcaacagcagaacattcagcatatagaatggctctacacagtaatagtagttatgtactggagtgggggtagaacaggacacagaaacaactgtctgcagccttttatggatttctggggcccagtcaatagttcaatttcatttcttacctgttagacaaagctatgggctcccacacaggaagaagtagaatccccaaggacaggcagggaggtgccagaaatagaatcaggacaaatcttgaggattgcacatgtgggggtgggggcaggaagcagaaaacccatgaagccaaagaggcagctggacatgggacccagcaactgctgcatggagaagtgctgatgggaactggtggtggcctctcaggactgaaacccacaggtaagcttgtggaaagccatcagaagccctttcctttcttttaccacaaacaacctgatctcaccaaacagaaacctcagcatcaagatggcaaaggagccaagtggggtggtgaaggaggtgggacactgaggccaggcacccaggcaccactgctacagcatccctcttccttggaaggtcctcaatcaaacactgtcatgtgcaaaaaaaaaagaaaaagaaaaaaaaaaaaaaagaaaaagaaaaaagaaaaaaacaccttcagaaataatcctttgggtgatctcttgtcaatcatttgtgcggctagagaggcacctgtgaatgataaggctactgagaagcatcattggcctggtcctgcactaccaaagggcaggggaagcgatgcccaaggggctcctgaccagcacatcatcccagcaaaaacattctccaggtcccttgttccaggcaggaaatccccagctctgagcgccctccagggctctgcctagggacaccttttccaggtctagagaatcaaaggagcctccagagagctaggagggcctgagctgaccaagcaagccctgctcacaagacaaatgcagtcaagactgggtgtattacttgtcttgagctctgaagggcagggaggggtctgagcctcaaatcaacagagaaatgctcaagtcacttctgccaactcactgtgatggcagctacagatgacagccctctcaagactcttcagctcacagacaagccactgacttcatctgtacacacccccaccccaatgcaagcccactgtacacttacaggtataaatgcatttgcaaggccttgcaaatgccctatgtacgtaaaactgacccacaaaatccaaaattgcaagtgccagatgccagcaggtcagaacatcctggcttcagcaatgggctgctcagcatgggagccttttatgggccggcctggctgggctgccgctcccttcccagcatgacccaacaccaggctctctaggcccggcggaggtgggctcttgaggcccagtctggcctgatgcttctgtgctcggtgctcctggtagcaaggcgcttctgtgaccctgggggagctgggtgcttgagccccaggcccctctgcctcctctcagggccactgtcagtgagggagccctggccaccagcactcaggtcctgtacctcttgttcaggtcattgcgctctgtctgcagtgcccggcacagcttctccagccgttgatttttacctgcaggccctccagttctttatcccggactgttttctagggaaagaaatagaccttcagtgccgtgccccatcaacctcccacttaccatcaccacttggcggcaaacctttaacaaggctgagagcagaccgagtccaaagctggccccctctaggaaacagtcctgttgaagccatgactaggctgtcaggtggggcagcatggtgcagaaaaggggcacggctggagataacgtattcctccatttatctaccacgtgaccttggcaaaggacttgacttttagcctgtctcatctataaaacaggactactaataccatcctcagagctcaagagaaggtcaatgaacaacgtacctaaaaacattcagcagcaaaaaagacaaaaaaaacccaaaaacttcagcaaggtctggcttgcagttgctgctccatcgttagttcctttcttctacattacagctgtgaaatcacaaactacctgggctgctttacatgtaaaccaggcacatcactggcccc

SEQ ID NO: 5026 - DNA, 100000 bp, Homo sapiens
aagcaaaatggagttaggcttgttttctctgttgttttaacattatagtaagtaatgtgctggcaggaatgatgtttggactaatatagttgataatagctagtattttggggtgattatagctagtatttgtggcaggcactgtgttatgtgcttttatatacactaaatcatttatgttcacaactcttgagtagtgtaattttttactttaccaatgaggtgactgtggctccgccacagttagtggagatggtcaggtaagaaaccagccatctctcctctgagccacaacttaataagtggcagatttagcatcaaaattagatcagccttttccccagagctcattcaatcctaccacactaaagaatttcagatttgttagcaataggaacttttattttcaaacaatttgtgggaccctggtatattaacaaatgaaaggagagctgcttggttgaaagtgaggaggatgtctaactgtacccattagggcctagagagaaccctaagtctttcataagaagtgttcataagcccttgttctataacataacataaaattccccaagagcatcgttcatataaacatggaactattaaagctaattgattgtttttagcttataataatttctatttactctgttcatatacctatctctatttttgttcattttcttggcctgtttgtacttatccaaacttgaggtgtagtcacactggtttctgcatttattcctcacctggatcatttatgatttatagttgaaagcttttcttcaagggcctcctgtcctttcagggtctctgactctaggatatacctagaaatttggtttctttctttctttctttttttgttttttttgagatggagtctgctctgttgcccaggctagggcattgtcttggctcactgcaaactccgcctcctgggtcaagtgattctcctgcctcagcctcccaagtagctgggattactggtgcctgacaccaccccggctaattttttgtatttttattagagtcagggtttcaccacgttggccaggttggctcaaactcctgactttgtgatccacctgcctccgcctcccaaagtgctaggattatagcatgagccactgcgcccggccgaaatttggtttcttaaagaacaaattagtttttcttctggtgaaaaattaggttaacaagtttaccttctttccttttattgtccatgaaatcatcgcaagataaggcagcattttgtcacaaaatcaggttttagcagaagattttttgccagggtctgtggttgatgtctccatttgggtcttatttttcttttgtgccattatccttatttgcctggtctgatgaacaattatagatgaacattctaaagcaagtaaacaacaataaattttaaatcatatagtcatccatctatccatctttatcttcatgcacataacatccagtgccaataatatataaaggaaggatatactggaaccatactttctccctcaaatctctgattccacattggtatataatttctgtaatcctcaatttcttaagctggcaaatgtttggacgggggatatgatcctttcagccacagatttgcactttttttttttctcactttcctttcttgctgtccatttaatttggacaaagcatacagtgagtgaggctgagtgccactcaaatcggttattctcagccctttttctgatttttgtgaattattgtatatttccaaaatgacttaacatacaactatcttttgaagacaacctgacaagattaacattcatcgttggaaattgtggaagtacctccacgtaactctgcatacccttgcaggtccacatcacttttatgtgggatgaaactttttttttctttctttctttttttttttttttaatttgagatggagtcttacactgttgcccgggctggagtgcaatggcgtgatctcagctcactgcaacctccgcctctgggttcaagcaattatcctgcctcagcctgccaagtagctgggattacaggtgcccgcaccatgcccggctaattttttgtatttttagtagagacggggtttcactatgttggccagctggtcttgaactcctgacctcgtgatccgcccacctcagcctcccaaagtgctgggatacaggcgtgagcctaggcctagggcatgaaactttcttacccttgcaggtccacatcattttatgtggagtcttcattagggcatgaaactttctttacaaagtggtgctcccagtcctgctagaagtcccttattcttgtcttgttagccaggattaaaataatgaaagcccattcatgaatataattaatataagctactattcactttctatatcctcttttcttttccaagttaaaacatccagaagagattaaaaccagattttcccaaatccttcaagttttctatgtcaatttcaaagttgccagagatatacaccaggtttattatagatattctctgtttattcttcccttgtcattcagcaaaagtgagcagcagttggaaaactgttagatttcaggtgccacaatagaaattgcaataaccaactccatgggaattttctgtttgcgatggggaggtccgtagatacacgatttttttcttcttgtttttctttattcactcttttgcattcagtaattttcaccgtcttaaaagtaatgttaattctctagggcatctttagaattccttctcctgttccttatcaattatttccaacaccctacataaatctttcatactattgataaatcatatctaacaagaagttattcatactttttttaaaattcctgtaagtctcataactgataagactttaagctctttctctctagagctctcatctaatctcacattgaaatgccttctgcaactgagaagatttctaaatgtatttctgaccctcttctcttttctggatgctggacccaatatccagctctagatgctatttctaagttgaatatctagcagcatatcaaactcaacaggtcaaagtagaaatcttatttctccctgaacttgctcactctctatcttctgtgtcaatattggcaccaccatcagtccaattgctcagaaacttgggagtcttttgtgacacccttttctctcactccttgtaaatctctgactcattcagcaagaacttccgccaacatagagctgcagtttcccatttcttagcatctcttctacaaccataggagtctaacccgtgtttctgactcaaaaacagcaatagtctcctaccgagtgtctccacttttactcttttctcttatttccacacaaaatccagagtaatcttttaaaacatgctaattaatcttattattccctgtttaaaaccttccaatgggttggtagtgcactgagaattgaaataaaaacactttaccaggctttcaagactcctggtaacctggtttctattagctctctgacctcatctcacgcactgcccctcttttcctatgccttgaaaatgttaaatatatttctgtgttagagtctttgcctctctgttacctatgcctacaatgttattcccctagttcttctgaagtctaccctttcatcatccagattttggctcaaatgtaaacttctcagtgaagtcttctctcattcccagtcagagcagtgcccatttcttcatccctcctcccacaagtcactgtcttcgccattgggttaaaaaattcattgcaattatgaatattagaaataatatcatttgtggttttactccatccccctccccttttcactgtgatctttttagggcaaggaccacctgtcttcacagctgtcaactggtgccagtacagtgcctggaacagagaagtcctcaacatgcagttgtgatatcataaaacatgaatgtcttcagcgctcttgaatctcaagtgaaactagctttttgtaagttcttgtaaactgaccagcaagcttttttttgataatagaaaactgtggaatattaacttattctgatttcaaagaaaatgaagtatagtttcggacatttaaaagaaaaaaacctcctcagaattcagaaaggcatttcatcaagaaaaattccaccattttcctagattagctgagctagaacattaggaaaattacctacctgtatcagggatgaagaggaccacctcataagtactatgcagggaaaatgtaaacacaggtagaccttatcaaaccatcacattcagagaataattcaagtctcttcaatgcagttgtgcagccttgcagtgtttggggctccattactgacctgggaacacggttctaaaggaagctaccttgcaatatcttgggccacaaccagaagtaagacaataaataaataaataaataaataaataaataaataaataaaacagaacaaaatagctatacaaaatacaaaatgtttgtttaggtatgtttgtgtgtacttacgcagaggaagggaaagtctagggaagtggcgaagagagaggcaaagctgactacattatctgcgtggccattgcaaaatacaaatgtgagactccttgattaaaaattatgaagaagaacaaaacaggacagtagactattgtcccagaatattaaaccaaacacgggtcttatgagctgtggccttacaactgcatagtcgcacacccatgaagcccaccctggttggaggggagaattataatcatctccagcgaatgtaaagcaatccccaccctgccaaaacaacagtaaaaataaacgggatccaaattagggcaggttgtgcccaatcctgatggctgtgcttgtgatgacggtggcgtgctgaggtggacttgggggcactgctcctatataacagactttagattgatagaggaaaggaaaatagtttctgaagctccaaagtagaaacttcaggcgcaaagaataaggtaaagaaaggagaccgcatcagacctccctcctgcccttgggcagtcaatgccttttctttccaagcgaccctctccttagatcactgtgtatatccggtgccttaggagctggggtggagtcgtaggtttggctgtaagggcgcgtcagagcgacaaaaagggtagagacaagtttaaaccctttctgtggagtggcttcctaccctctttggccacaaaccccagggctcccagagggcctggatgtaagtgggttccagatgacccatcctcccttgaccctccgaaggtaagaccaaggggaaccgctgtgatcagcattcttgaattcctcaaaagtcacctcacttgtagaatgcgtagtcctccagcatttggaagaggtggcagggaccttggggcccgggaagttcgcaccccaggaagcgggtctgaggcggtgcaccccatccactccgtccgcagtcggggcgggcagcgggacccgagaggacgggaatccctgcagggagggaagggccgcgcctgccgagcggctccgagccccgccactcggtcctatcccggctcgcggaggctcaggccccgggaatgcgggcggagggggcggcgaccgggcaccctgcggccactgcggccgctgctcctgcgctcccgcgcccgccgggtggtggctccccagtgcccgcccccagctccccttccccgccctcacgcccccttcccgccccggcccccgcccggcgctcgggccgcgccgacccgtcgcccgtccttccgagcgcgccaggcggcagattcttggcggcggcggcgcctccccagtgcggcggccccgagccggctgccgcgttccgggcctcagagtcctcccgcctcggccatttccctcctccccatctcctccccttagtcccctcccctcccgatcctcatccccttgccccccccagcccagggacttttccggaaagtttttattttccgtctgggctctcggagaaaaagctcctggctcagcggctgcaaaactttcctgctgccgcgccgccagcccccgccctcgctgcccggccctgcgccccgccgagcgatgagcgcccctccggtcctgcggccgcccgtccgctgctgcccgtggcggcggcagctgccgcagcggccgccgcactggtcccagggccgggcccgggcccgcgccgttcttggctcctgtcgcggccccggtcgggggcatctcgtccatctgcagatcggcctgagccgtgagccggtgctgctgctgcaggactcgtccgggactacagcctggcgcacgtccgcgagatggcttgctccattgtcgaccagaaggtaagtgccgcaccgctgccagcccggcgcctccccgcggcgcagggggcgctgcccggctggcctctccgcgccaactttccggctcccggggctcggctggccgccagcctcgccggcgctcggaagcggctggccccgccgcggctggacgcctgcaacccgaggcgctgcgctcgctgtgctcatcctcctctcgccccatcttcctctattcaccgatttctctccagtccgccgcccctcacccatttccatccttctcatgacatttccaggtatcttgccctttcctcgccgccccctccttgtccttgagacttcccagttttcttcccctctctcccctacggaccctggccagcgcattcctggtgcaggaatcctccttcctgcaccagagtgcccctggaatgaccggagacaaggaatttctcacctgtcagataagcttttaagagagtgtgattgactcggcagttgtcaaaacaactgaccaggagtgcaggtacccaaggccttgtcatcttttagttcacttctgtatgagcatggaaacacattttccaacgacaaaacctgaaagttgcgaccttctatttttcattcccgggatgctgatagtaggacgttgaagtggtgggggtgatgtccagaacaccccgaggctggctgtgtccttaagtttgaggctgtggggctctggacagcggcactgaaggcaggttagaagggtcattatccggggccaggccacccccagaggagactcacccacccaccactgtttacagttgcaacttggattttcaggttgcctctggagccatccgatggatgttgcatggaagggggtgatacagacgtgaggcagagggggccatggcgccatcttcttagtgtaaacagccagcgtttcaggagtggagacagaggtctctaaaggtgctaatttttcagccctggaggactggctagcactccttttgctttctaattatcacttgaaaatcatgaattgctttctttaaattatttgtaacagagtttgctaaatcttaagggttggaattgcagcactgagcacaggaatgttaaaagctccaggtggaaaaaaatcactgatcagaaagttgtgaaagttctagactaaggtaacaatgagtgccaggaatttatttatggaatttacttttatattacgggtaatgtcaactgtttgcaacttccaagaaaatgacacgtttgtctaatgctgatgtaagtcatatcatgctccttttccacatcagtattgtggaatgctattgtgggtcagcaggagcactcctaggcactgtgaaagccttgtatacaatcctctcatttggatgcagaccagttaatgaaacagcaatgcttcataagcacgtatacaatgtaaacaaaatttctcaaaaagcaaaggtaattctgtacaattttaacttttctaaattctaagcaagtgaagtagtgtcagagaatattcaaattgggtcaaagtaatattgatagacttgttttgaccagcttgaattctccctccaccccgccccccacttcctcctggagttcagatggggagactgatgcctagttcaagaggtttggtagtgggattttaaatggagggtgaatccaggtgtctcagaagctaccaaggggcgtgttacatggagagagtgagacgagagcaagggagagggacagcaagcacctatggaatgcagcaggcctgcaggtggtggcctgggttttaagggaagtacagttatgaaaaggccttgaattaaactcaaattgctagaagcctcgtaatcttttcatagcgacatcataccaaggacatctgaaagatggatttgctgtatggggttttagaatgccaaaaatgttatggcagaaagagcaccgaagttcagtcatgagctattggaacatgagtcaagacttgggggagagactgggagaaatactggaaagggaaaatctcagccctgattggtgactgatttataaggggaatcctttccttttgtatttattctagagtttcttctctctctcaaagaagtttgaaaagtttgactgtttggaatagttaaggtaagatctcactttttttttaggttataaaaaagttggggttagatttatagatgtgaactgagggttatttatatacagaatactgtaaataaatatatactggatagtgtttctggacgaggactttttcaatttctctgtcatttgtcatctctttcagaatatattattatcccacagaaacaaaattaagagagctgaaggtccatcacaggatacaggatctctgtgtgttggacagtaggaatggcagagtgtcagtgtggagttaaggaagtgggagggagttcttttgcttttatttcagtttttttttggaagtaccttatgaggacgtcagctatgaggaaggatacaggagtttggggattggatgtttcaggagagagcagagggtttgaaatcatttacaattactatgtgggctgaagtcgtgtggaacttacagcagaaggttctcctgatctttctggtcttccacatctgttgttttaaatgtgttaagaagtttttcattcactttgttcaggactccctaagtactaacatagatcatacgagcattggaaatattagctgacagtttcagtacatcacaggacatttcctttgggatgagcaactgaggtgtacaaggctgcataagtttcctgagaaactcacctgtaaattattattgttattatttagaatttagagtatagttgtctctaattatgtagcagacacgattgtacttgaaacattgtgatggtaattcaacaaaaatacttattttaagataacgtaccctaagtatatactgacttatataagtaaagaattattctttcatcttctagtttaggtgaaaaatctagtcttgcttttttgtatgtaacaatgatggctatataatatgttattctttctttttagaaagtattgatccagggttttatttaattatgtttgtttatttagtttgcaagtgtgtgacgttgaagcctggttgtatataaagtatgtattctgttagtgtacatggttattgttttcaggagggtaaaaaataataacaatattgacttcactttgaaacactgttactttctactgtcaaagaaaccttgaatatgtagctgaggaggaattgttttaaagcaaggaaaaaaattccagaggaagagctagtttggttcatagtacatcatctacttatctaccacacacacaaacacacacacatacttttttttttttttttttttcctcaaatgagctgtgttactctttagggatgcttgatgccattaatagattgttcattttggttattaccttattagaaaggcaactgatattttactcttaaatgacttaaatggagtaatagcatttataagactcctggcatatagtttcacttttcagaatatcttttggctaaagaaatttaacagtgagattttaagtagatagctcactaaagaagtaggttagtgccttggtttgaaagtagcattactttgcttgtaattgtttcactttaatttattatacattgttttcttaatagttgtgatgtcatttttctctttattactaattttaatactccacacattccacatagattgagaaagccgaaagtaattaggtgcttgatcaatcaactcacctggaccaacaaactccttttaaactaatgatggtctttggggcttaggtgatatatttttattccaattttataattggctatattatatgtctactgatttctgatttatgatgaagtatagaatttgtcattttactgtgtgtttttttttttttttttgacagaactcactctcttgcccaggctggagtgcagtagcacaattacagctcactgcagtcttggctccaggcttaagtgatcctctcacctcagccccttgagtagctgggtctacaggtatggtgaccatgcctggctaatttttaaattttttgtagagatggtattttgccatattgccaggctggtctggaactcctgggatcaagaggtcctcctacctcggcctcccaaagtgctggatttaaggaatcccactgggtgtgagccactgggcctggcctattaagtgattcttagtaatataattttagtactctaattttatttttattattttattttttgagataaggccagactacaagtacagtacataatcatagctcactgcagcctcaaagtcttggctaatgtatcctcctgccacagcgtcccaagtgtttgggactacaagtgtgtgccaccacatctgataatttttataatttttttatacagacaatgtctcactgtgttgcccaggctgttattgtttcctggcctcaagcaatcctcccacctcagccttccaaagtgctgggattgcaggcagagccactgtgccctgcctgtacttttaaaatttaaatttcttttcaagtttaataatgaacaggattatattttggaactgtatattatgtattacagatgtggaatttatatgtagagattatgtttaactattttttaaatatatttttaagagcttccttatccttgtatagctccagatgtgaagtattgttttatattttgtgttatagactgcaaaaaatgaggcctcacacatatctcacaatcccaaagagaaactctgctttatatttttctgtttttctttacttttctttttttttttttttgagatggagtctcgctctgttgcccaggctggagtgcagtgtgcaatctcggctcactgcaaactctgcctcctgggttcacagcattctcctgcctcaccttccaagtagctgggactacaggcgcctgccaccatgcactgctatttttttgtattttagtagagatggggtttcaccgtgttatccaggatggtctcgatctcctgacctcgtatccgcccgccttggcctcccaagagaaactctgctttatatttttctatcaattcacagcttataaacctttttaaaacaggtatgtactatttgacagttttcacaagaatatcctggagactgtgaagttaaaaccattaagccttgtagtccatgggctgggaagagttggatgttggctcatttgataaatacatgaattcatttgggcctttagattcagaattgagatcatctgaaagagtaaaagtacactgtgtatggtggtggtggtggtgggggttactggaataggtttaaaaacttgccccagaagaccatacttcatgactgtgctgtttattttcaccagttcctatcatagcttttatgggagatttataactttattttctaatgattattaccttttttgtgagatgattgtatataagtcttcactaatttattcatgaataactgttactgacttactagagaatgcagaacatttgtaagtcaatgaatgtatatttgtgacttatctaagttactttgagatttaaagacaatatatgtaacatacatactgctttgtaaatacgtgcaaataaatgctgttgtttactaaagcttaaagctctatagactagcatactgtcttattacaaaagaaatttatatttattatcttattcttatatcaatatataattaaaattataatttaaaaaaagcaatatggctgtaaggcccaggtgacatctttttcctgccctctgtatcgggcaaatcttagaagtagttatgttttgaaacagtttctcaaatctcaaactctcagcttctttaaggactaatctaattattactaaatgaaagacacatttgctgataaaagtaagcatattttcattgctttttattatttttgacagaaagatgatttaactccttttcaatacaagtgcaatgtcaatggtatttcacttcattttttaaaaaggaaataaaatagataaggtgcaacatttgggaacacaatgattcaaaattctggttctcaagaccaaaatttaaacttatttgcagatcatcgcttgatacatgagaaggaaggtgcttggaaatgacgtaggggattgcaatttgctgtcatgctaacatctagaggttgtttgctaaattgttccatctgagatagctaatataacataattggttgtgcatatgcagaaatgtcattttgagatgagaagcaaatttactgggaaacaattgagttatcagtttggcaaaaccaatcacaagtctttttagatattcccactacctaccacttatctgtcatggaagtccatgccccattataaaactttagaaaaccacaatctttaattatttataaatcttttaaagaagagtgtaatggatattatatgaaactttgtgtgtgtgtgtgtgtgtgtgtgtgtgtgtgtgtgtgtattagacggaatcattgaataagctctcaaactataccaaataactagtataatgatcaatattgcgggctggactcagactgttagaacttggtagaatgcagtcttataggtgttgatggtaaatgaagtttccttccttgctttgtttttatatttgtttgctttgatttatgtatcagggaatctttgacctctgaccttgcgccatcaccttgtttaaggtgaaaaatctaaacccaatgtggcaatagaggtaaaaatatagggtgttttttaataataaaagatactactcatctttaatttccccagcattactttagagtgattttgaaaatgagacttcaatttcttaaattttccttattgttggaatatgttggaacaaaacaagacaagtgcttccttccttccttgttccttccttccttttcttttcttctctcttttcttttctttctcccctttcttcctttctcttttcttttctccttccttccttccttctttccttccttccttccttccttccttcttccttccttccttccttccttccttccttccctccttccttcctaccttccttcctcttttctctctctctctctctctttctcagggtctcactttagtcactcaggctggagtgcgtggcaccgtctgagctcactgcagcctcaacttcccaagctcaggtgattctcccacccagcctcccgagtagctgagactacagatatgtgccaccacgcctggatgattttctgttttttagtagagacagagttttgccatgttgccaggatggtcttgaactcctgtgctcagtgatgacccacctgcttcggccttccaaagtgctaggattataggtatgagccactgcctcagcctcatttccctctttctattgatagaatttagatacaaagaaaatggtgatttccttacaactattcaaaacattttttaatctataagaatatgagatatttcccacaggattcttttaatactgtcaaccaaatatttttgtgccattaaaaaccagttgtgatagcacacttgaagttatttggcagcagagaaattcacgttgttctgtttcttactttttctggttcatctagaaaaacagatcattaaatatacagagtgttcaattatatggccactatggcgttatggaatatcatataatttaaatagttaagaactggtacaaaaacaatgcatattcgacaaatttcggctgtctaaatctacagtttcctgtgtagaagtttcttccaaagttataaaggttttatttggcttaagccagacaattgatatagtagcttagcaatgttggcaaaatgaaacttagattttaaaatatgcaatcacacaggaattttgttcaacttattttggtaaaaggaaaaaaatatacacccttcactagttcattggcatctattctgactaaaccacgattgatgaggaactagtgaatgtattgcttgtttttaggcacaatttcaggaatttctaatgcttctctccttaattgtcagcagccacttttccccgcatatattataaaacagttaaaagtattaatttagtaatgaaaatatgaatgaaaagtatgaatgtgcataatatatgtgttgttgataattagtttgattttttcctacactcagtgttcttacagttaggtgatttctcaacctgagcaattgctcagtgtagggtgaaaagattaaagagattgcttatttgcgttatgtaaatatccacagtaatcatgaacatttttatttttcagtttgtttgattccaagcaattctggttaggagtggcatgttatacaggcttttgcaaaagtattgacattattcacacaatgtcttgtacagtcagagagattggggaggagaggactgaaggggcagttaaaactagaaataaagagtcaagtggtaaattgaaaaggccagaaaagtggaacattagataaagggtcaccacttgtgttacggcaagtatttcagctactgtgagcaggtgaacattggatctaatggttagcaccatctgaaaatatattcagaagcttcctaatcaaattgtacaatggtacatatttttggtgtcattggggtcataataagtgtttttcttttacatttttgaaattactatttgatattttcatagttctgactgtttgaattacctgtctcacattgagtccctttgtaacactgcaggtgatcctacaagattctttctccctccccagcattattaggtataatttactaataaaaattatatatactatgatatataatgttttggtacatgtaacattgtgcagtgattaaatcaagctaattaacatgtccatcatctcacagacttatctttcttgtgtgtgtggtgagaacatttaaaatctacaatcaggcaatatatttcctgcttgaaaaaatcaattttggggtactaggcttagtacctgggtgacaaaataatctgtacagccccccatgacacaagtttacctatgtaacaaaaccgtacatgtaccccagaaactaaataaaagttaaaaaaatctattttttacttaaaaaattatctacaggtatgtagatttgcataatcatactcttcagttcatagcacatttttttcatcagtccaagtaaggatcctatgcgttatgttttattttgtttcattatttattttcaaccaggcattggaagaactgtggataggtatgaagtattgtatcttgacagttgaagcttgtttcagtatacaaagtttttccaaggtaatagatggttaagataaaattaaaagggtattcagcattttaaataaagagcgtatctcttttctttttcgtaaacaatagaataaaaagaatctgaatataattaaattcaacttgatatgtcacaaacagaaacgtatttctacatcaactaaaataatttgttcaaaatgaaatccatgtatcattacatgagcctgctgttttttttgtaaatggtttaagttgattttgactaggaatttttgcttgaaatttattcaccgacatttatgttgatgtaaatttaaactttcttaagaatcaaagcacttttcattaattattaagattaatctgttaggttaagtgttaataaaagtttttaaactgtcagttttggccataccaaaaatacagagcctttcctaggttgtctaaatccatcatattaatgacataataattacaggatgattatggaacatttctttgttttgggtgaatgactagctagaaagagactggggattcagttctagttcggtgctagaattaagttccagagacttgattgaattaggccatttatcaatagtcaaattttattaaagacactctttcttaagctttttatcaattaaacatgaacatttccccccccccttctaactcctcacattgttcagaaatggtggtaggcttgtgttctggtagggcctttgggttagaccagggagttcttatcattacaaaaagtggctatgtccttttcagagtgtaggagatcatggttagaatttagggaggaacacacttaagggagcatttggcagagggctaggatgagttcgaagacatttcagtgtgacttctttgccacgggaaaaagagattatagggtgagacttgatactatttcttagcctacagaaaggtgaggtctactgtccattttagacatctatatagttctgtggtgcaaagctggtatcatctttgcatttagcatccttgaaggcttggtctgtgtctctaatatggaaatctgcaagtaagaacatgggtgaccaagatcgcagttatttagagattggttagtgctgttagatcctcagaacagtaacactagaggtatgaccacttgaccaaacagccgtagctttttcaccattgtcaaaagcaggaaagagtggggaatggtgtcagttaatctttggtgatgactttgaatcagtggtggtgaatagaccgaaacagtgacaacaggcaaagtctgtgggcttctgagacttatggcacctgagggcagaaagaacatgacagcaaagctctgaccttcctgtggctagagccagaagaaatggccacctagatcactcaggaataacagtggaaagagatcttggaggttgctttttacaagcggatagtcctctttagaaattccatgagcatcacaggtgagagctccaaagagcaacttcatatgacctgtctgtaagaattttgaaaagcttatcccaggagccttgggtcatgataggcaggttccagggcctcttctggaaaattctgtgagtgtcaaagcaccttgaactggtggttctctcacagtacaatggccagcagaggggagcctccaggaacaaaaccttcctgacattactttgtgtgccaatctgtatcttggcttttcatttgtcttttctgattttcacagcaccctttgtggtagtaattttatctctattttaaggatgaagaaactaaaggttggagagttaaattatttacctcaagacacacagctactacgtaaaaagcagaccctcccaatacttattcgcttgcttgaaaggccgtagatttgtaggaagagtttggaattatcagattatggaggaaatttaaatcttcctattgtgttggctgaaatttacttaaaaatgcttaaacttgacagtgtggtattattgatttatttgaattattccttagtctagaaggcttccctcattggaattcacatcccagttagtgaccagctagaatcctagtcactttggaggccactacacaaggattctcttattggtggcaagattcccccccacttcccaccccttcagcatttaaattaatagagagaacattagaactggacggtcattggggaaattagtgaaatttgagaatatttttatatctcttttagaaatactaaatctgcctgttttaaagatactcctcaccttgaggaatcatatgatctatagtacgtctaattgtaaattttttttgaaatatatttcgtttgtgtagcagaatttggtttggaatttgctcctctggtaacaaaattgtggagataccagtccttacccacctggacattttcagatgccactgtcttcatccaaagaagttaataccttgtgtaactgaattggccttttttccaataagatgtggccaccaagtgttgtggagaagagattatggtaagaccatatattgatcattgtggttcaaaattagtagatgtaaaaattacatttatcagtgtaaatcaatgaatcactcttgaatagtacactgattctgagcggttctgagaaaacaactaagggtccttaagaaaagtgcctttcaggctgggcgtggtgctcatgctgtaatcccagcactttgggagactgaggtgggcagatcacaaggtcaggagtcaagaccatcctggctaacatggtgaaaccccgtctctactaaaaatacaaaaattagcaggcctggatggcgtgaacccgggaggcggagcttgcagttagccgagatcacgccacgcactccagcctgggcgacagagcaagactccgtctcaaaaaaaaaaaaagaaaagaaagtgccattcagtgtttgcttttcttatttatttatttagagatggagtgttgctctgtccccagactggagtgcagtgtgatctcagctcactgtaacctccacctgccggttcaagcattcttctgcctcagcctcctgagtagctgggattacaggcatgtgccaccacgcctagtaatttttgtattttttgtagagatagggttttactctgttgaccaggctggtctcgaaccgccttggcctctcaaagtgctgagattacaggcgtgagccactgtgcccggcctgcttccttttagaagtagtatttgggttgtatatttgctaagggtcattcttcacaaatatgatgtttattcttttaataaagtttgtttgcttgcttattttttgtcaattatgagtgaaccacctgaaggtaaacttactcccacttgtacatgatcaatcaccagctaagtagaagtttctttccacttcagcggttgaattgaattgtgaattgccttgcatcctttcacattgttgtgtccagggctaatgccaacacgtaacttccctcgtagactaattgtactttcctcaactttacaaaaatgtagatgtaagtgtgtctatatataaagagagatgacttgacctaagcacattcacaattcagttcgattctaacggttcctgccctgaatgagtactgcatagctacagtaaagtagttttccctaatgtactagaaaggtgcttttctttgatgtatttggacttttgaactttagtacaatggacaacttacatagagacttctcttttcacgagttactgtagtatcttgctaatgaaaaggcagcagacatctccagctgtactagaggtctgaattactagatatctgttagtcaagtactgtgccttgtaaaccttatcttcagataactcatctagctagttggacacagggcgtcagttgttgcttgagtggtaaagcgaatcacgcatgctagctttcctttaccaaattacgagtactcagaaataactgattaacttcagagcaaccttgtgacagatgttaatttcatctactaatgtggaatgtcaactaggatgtagatcttacaatatttacataaacccagtggcttccatacatttttgaagaatgaaaaactacatctgcatgatctttgcctttttttcaattctttgagaaggataaggagcaaaagtaaacataagtgaggatggattaatggagaggagttgctctaatacactaaattaaataggctgacctatgctctgttgtccaggacagtcccaattccatgcctgttgtcctggaattcttttaattgtatattcactaacaaaaacaaacagtaaagaaaaacagaaagaaaaacctgacttaggcacacattttattaccttttggccaaaaaacctgtacatttaaggagaaaggtaaaattacatttcatagaaagagtcatcaaatcatgtatattaaccatgtcatttttggtaaccttctaaatggtttaagctaaaaacaaaaacaaacaccctacttaggttagaatgttatcactttgaaacaaatgtttctgtataacttaaaaatgaaaagacaactaacatttagaatcatttcgtaagctaattgcttagtctcactttgaatgtaatatataaagtagtttcaagctctttttcaaccagtcagtaatccaagatactgcaatagtgcatttgtatcaaacagaaataactttgattattgtggtagtacatactaaattgattctggaggtacataataccttattaattcaagtagttaaacagaaaagcctgctttgaagctgtagcgtaaagtgctctcacagtcatgacaaaggcaaaatacatggacttagatgcagaagggtgacactgtgtacatagtttcaagttgtactttattgtgttcttttcactggagaaaatacggttagctaaaaaggaggaacactatatacagatgtctttgattatttagaaaatttgttttttatttaaaaataagtaggcaaataagagagagaaaattttggaagttgggttgtcccaaaataggatgtacggactgtagcgcatatttgcttaagatgttcagagtcatggtctgggtgaagcgatatgtgagttatacctattactctatacttggtttctgttgatgaatatactattgagtcatgttaagaattataggtttggaagtcacaatgttgaatattctggctctgaaaaaaatgcaagtcaggggacaaaagccacttgaaaaggaacttgatttaatcattcctgtttgaattttctccatgtggaaaattatgatttttatactttaattaaataattgttttttttgaaaattacaaaataacacttcgtggtaggctaaataatgaccctccaagatgtctactcctaatccctggaacctttgaatgttaccttataggtcaaatgggactttgtagatgtgttaaggattttgaaacagggagatgatactgtgttatccaggtgggtccagtccaatccataagaccttaaaagtggacagttctcctaactaggtcagacaggtgaatatgaagagaggagcgattcaaagaatgagagattcagtgcccttttgctgactttgcagatggaagaatgggccatgagccaaggaattaaataggctgtaagaggaaagcaggaggaggtagagtatgtagtaggagatgtgacaacagaaacaagatgttggaattattcgaggagtagctcagagccaaggaacataggaaaagctagaagctgcaaaaggctagaaaagatttcttccttcagaaggaaccacattttgacttttgcctagaaaaactggtttggacttctgatctccgaacagtaagataataaatttttgtttagtaaagccactaagtttatggtaaattgttacggaacagtaagaaactaatatgtcacactcattgcagaaaaggtgagaaattcagataaccccaaagtggatcatactactcagagttaaatatagttaatattttggtggatatctttttttttctgtaagcaaatatgctcatccaaattcaaatatgcttttatttgctcttttatttgatacttctatgtcagttttgaaatataaaatgttcagtgcccttggggatagtttatgtgaagaaaagacttcagatatgtacattggttttataatttaatattcaagttataaagttgtagattcagatgttacttcttaatctttctagtagaacttaaaaatataaatttaataagtctaacagatttgaacaaccacattcaacaatctttgaagaattatggtatctttacaaacttaattattaaatgctttcaaacatttgaaattgcacttctaaatttaaatatttgatttcctttaaatacttcaatcacctgcttgataaacctttatatgttcttagtagttcttacacacctaataaattaaacataagtattgcaaagtttaagtttttcaatttccgataccacacacacaagccaaaattaattacttaatcatatgtatatagtatgcaaaaagtaatgatattatggttttgattctcttaaacttctctatgtttaatttcaaacctcccatgtttgaaagatattttttcacctgtgaaataattgtgtgattccacacaattttggagttcccttctcaccttgtcatataattttgcagttgtcttattggctcgattaaattgcacaaacaccaaggcttttagctgggacaaagattggatttttgtgacaagtatagtcaactccacagaaccctatttctatcagtgattctatcacttcaagaaagggggaatctgtatcccacatccctggattccatttatatattacctctttgtcctaacaagtctcaattccttccttgattgatcacttgattggatttttaattccgttagctcttaagataggcaatctcttttttatctacatgaaagactattgaagttgatgaaatactacactttcatatctttctttctcttaaggctacattaattcttatagatattaagtatgtgattgaatgtggcagtctctagggctttgtgaaactgtgtccaaaattggtgggttcttggcctcgctgcttcaacaatgaagccacggaccctcgcgttgagtgttacagttcttaaaggtggtgtgccagagtttgttccttctgatgttcggacgtgttcagagtttattccttctggtgggctgtggtcttgctggcttcatgagtgaagctgcagaccttcgcggtgagtgtcacagctctaaggcggcgcgtctggagttgttcgttcctcccatccggagttgttcattcctcccagtggttcatggtctcactggcctcaggagtgaagttgcagaccttcgcagtgagtgttacactcataaaggcagtgtggacccaaagagtgagcagcaacaagatttattgcaaagagtgaagaacaaagcttccacagtgtggaaggggaccccagcaggttgccactgctggctaggcagcctgcttttactctgctgattggtccattttacagagagctgattggtctgttttaagagagctgattggtctgttttgacagggtgctgattggtgcatttacaatccctgagcggacacaaaagttctcccagtccccactagattagctagacacagagcactgattggtggtttacaaaccttgagctagacacagggtgctgattggtgtgtttacaatcctttagctgacgtaaagattctccaagtccccaccagattagctagctacagagtgctgattggtgttttacaaaccttgagctagacacagagtgctgattggtgtatttacaaaccttgagctaacacagagtgctgactggtgtatttacaatcccttagctagacataaaggttctccaagccccaccagattagccagatacagagtgctgaatggtgcattcacaaaccttgagctagcacagagggctgattggtgtatctacaatcccttagctagacataaaggttctccgagtcctactagactcaggagcccagctggcttcacctagtggatcctgcacccaggccgcagtggagctgcctgtcagtcctgcaccgtgtgcccacactcctcagcccttgggcagttgagggactgggcgccatggagcggggatggcactcactggggaggctcgggctgtgcaggacccatggggggcggggggggttgggtaggggggaggctcgggcatggcgggctgcaggtctgagccctgccccatggggagacagctgaggccctgcgagaattcaagtgcagcgctgtgggctggcactgctgggggacctggcgcaccctccacagctgctggcccaggtgctaacccctcactgcctggggctggcagcgccggccagccactctgagtgtggggcccgccaacccacgcccacccggaactcatgctgacccgtgagcgccactcgcagccctggttcccgttgcgcttctccctccacacctcactgcaagcagagggagccagctctgaccttggctatccagagaggggctcccatagtgcagcagtgggctaaagggctcctcaagcgtggccaggtgggtgctgaggccaaggaggtgcccagaatgagcgagggctgccagcacactgtcactcttaaaaccgtctagtcacaactcataagaccattgttcttactcgatatcttcctctgaaatgaaagaacactcatgacaccactttctagtgtctaactagaattggtatatagattattgcagtatatttaacttgtaccctactctttgaaatttaggattctatttttttgttgtttttctttgaaatgtccttatgcataagctgtaggatattttaaaaattgaccaagtaggctgggtttggtggctcacgcctgtaatcccagcactttgggaggctgaggcgggggatcatgaggtcagaagttcgagaccagcctggccaacatagtgaaaccccgtctctaggaaaaattagccaggtgtggtggtgggcgcctgttatcccagctatttgggaggctgagcagaagaatctcttgaacctgggaggtggaggtcgcgttgagctatcatgccattgcaaccatccctggcgacagtgtgagtctctgactcaagaaaaaaagattactgatgtaatagcatattgaacttattttgatattatctgttaatattactaaaattaattcctaagattaattgttgtttttatttcagaattataatgattctttgcttttttcagtttgaaaagtgaagtgcataagttttttttttttttttgctttgtctttacacagaaagatcaagatgattaagtacaagatgcggaataaactgttagattcaataaccaacacttaaatggattactagtagactacatatgaaatatatctaacagtttcacggtgaacaaataaactataaaacacagccttacactttcaactttcctgctcttctttagtaagaactggcttgatttttaaaatatgtgtcacatttcactttgatcttttaaaaacagtttggaaaatatacatctctaacatgtttaagaaaattccataaaacaattccttagtagtaaaaaactccattttattctatccagtttgttctactctgcagtattctttagaaatctgaagtacaaatcttattttagacacaaatatgaatgtcatctttgacacgtccatgtttcactaaaagtcctttctttgcaaaagaaacagttgcttgcttattaagtactgtagagctgtctttggtaatttgaagatattctgattgagaaaactttggtttatacaaaaagtttcaggattatctttattcagaaatttagtaagattgggtcaatcacacgagagtataaacaccacacgaccagggatcttgcctatttttttcactgttatatctcagatatccagaacagtgcctggcactgaatgatgaatgaatgatttgtctcattattttcttgttatgctcttagaagcagaattgtgtggctatgtgtataaaaatttaagtcttttgttatacctgggctctttgctttctagtaattttcttttctacctttgatccataattattattcaaataatttttaaaaggattttgtgaataagatgtagctagggagaatattggacgttgctggaggaaacaaacagaagccccgggatttgggtcgcttctggggatttgatagtcctctcaactaactgggtcaaagatttaagatagtgaaagccttcctttctgagaacattttatggtagggcctgaataaatatttgtgaattgagtctggaacagaaagagtcttttgtgattgttagtggatacctagttgaaatttatgaaaaacatttcaagattttacttgtcaaatctcagcctaatttacctgtagatttaagaacaaaattatgcgaataataaaaagcctgacaaacaaaatatagtggtaagagaacagtgatgctgaggaaacaataaagtctttggagaaaaaaatcagaaaataacagactacccaatcaccccatgttagctggaagtctctttgtcattgtttgttttttcttccctgttcccactcacctgtgaagtgaatttgagaaactcagatgggctgacagggaacattcacagagtggcctccagccaagaactttttagtcacttgtttggctgctttgatgtgagtcgattgcagtttaaaaacatttaccttttcctcatttcctgtcaattcataaccttagttctttaactttttacattttacatctcagttactctgctctgaatttcttaagtcagagttagctttttttttttggttaaattgatacaaggtctcactctgcctgggacgtgcaatctggctcactgcagccttgacctcctgggctcaagcgatcttcctgcctgggcatcccagagctggaaccactggagcataccaccatgcccagttaatttttaaattttctgtagagaggagtctccctgtgttgcccaggctggtcttgaactcctgggctcaagtgatcctcctgcttggcttcccaaagtgctggggttgcaggcatggcctactacacccagcctagatttcgctttttacatgacttaaacttaacgcttactttaaaaaatcatttttatttatactttaatacttattatatactagatggtgggtattaaattacatatctgtatccatttctatggtgtgtgtttattgtcttattttctgggatttttaaaagggtttttctaactttaaaaatttctcattgattttagttcttgacaatccagatttacacctcatgtgttttaaatttttgccttactgtttttatcttttttctctttataatttgttttctcatgcagtgtttaagcttctcagatattcttaaatgtctcagggatactcatgagttgactttctcgagagttaaagccccgctgggtggatattatatttgattttctggagccttgttgcccgttaacatacattcagttcttgaatgattaatctgtcgtttcccaaatacatacccgctgtattttaacaaacagttgcgtgctgtaagcctgaagtgggtgtaacttctgcagtcaaccttgaggaggcttctcccagcccttggtgcacgtcaatcattcatgggaggtggaacagtagtgatttcagccatgtttctagcactgtttttaagctgtcttgcttctgagatacttattacaagctggtcagtttcctttcctggcaagattttattaaagaactgagaagctggtcagaagaggttatcccaacttggattttcacaaatcaatactttttttttttcctgctggcaaatgttatttaaagttatcaagtatatattttacctaggcattttaagagtaggcctcttgatcacaaaaagcattcctcctattaagttttggattatagaccataggacacccacattcctgaagtgcagggacatggaagactagagtccctactgggaaacttggtcaaattttaggattggtccaggttccggccctcttgatgatgtagtgtgattccacctttctccttcaaggttttgtgtctgacttctctttcatttttgggctgagggagctggaaacaatcccctcgttgagcgccaaacccttctcaggggtgactgtagaagttacactcatttcagcctgtagatgcaaccgtttgcccaaagtacattggtatgtatttggcagaccacagtccagtaattccgttgtggtgtacctgaaaatcagtttaggaagtgtcattcgtttggcagattcagaggcaatgtcatccaaaaaagtgaccacgtattccccacaaattattgatttattggcttttgtccaagttgatttccaactgaaaattcaaatctaagtattttagaccgatgattttaaataggagtgttaggatttaggtatcattcttgtactgcctctttaaacagggaataatttaagttgttttcaggttttattaatccaccttggcctttgaatctatggataagaatttgagctaagctgtttgaactcagcatatatccctaattatttaagctccatcagaacctcccagtaaggggagtactggcataaagatcagtaggaatccacttctcataggtcagttaaatataatagcaattattgctatatggcagtaataatagcaattattattgctagtgtattatccttaatatagctaacatttatcagctgttactataccagacactcttctaaggtcctacctagacatttaatacatttaatttgcaaaagaacctaagaggtaaacatctatatccttattttgcaggtgaggaaattggggcacagaaagaattgccctggattatatagtagtggcagagttgggattttaaattcaggcatcaagcccaaagtttatgtatttaactccagactatatttatggaacttaagctttttcaggcggtttaataaatctgaataaacatggttcctcttcccttttaacttttttcttaatcattttacagtgcttttgattgagctcaattcctgttgtagtgaacacaaatacactattcttttataggcagatctgttttatttttggaattacagggatttcagcctagaggctgaccctgttaattattgccataaaaatagtacctataaacttttctaaatctaaatttcttatgttgccaaatgtttccaagtttaaattggttcaaaagaggcagttatatgtgtgtgtgtgtgtttgtatatgtaaaaaatactccgtaaatatatgtgtatgtaaaaacacatgtaattatatataaaatatatatgtatgcttcagtttcttggtatctttatttttacgataaatttaaattttctgaaagagcatataaagctagactgtacaagcttaggctttattttcactttaaatgatggacttcctatacatcttcagtacccagccttaataaacatctaaatatagacaggcttttttcattaatcatttttgttcctcagttgtcacccctttatccctttctcctcagattattttaaaggtaatattaagatttatttttaatccagggttttgagtcttcagaatggcttttggagaacataggatgttggaatagtactctccctgtcaggggatatcatgtgtttaggtgcttggttcggaagactaccttttacagttctcttatatgttatggcatgtggttctctatttaactgcaacaaagagaactgtactccaggcattatgctgatggttgttcctcagtagtatccgtagagagagcctgtatgaataattgattgaagaacatacattctgtcccttctcccagattttaaaaatatagtcctgaaccaagttatattaaagggtcgtgtgccaaaggtattgcataatgaaatgcagaatgatttgtggtgatgccattagcccgtttcgaggctggttggatgtatgctcctgtgcaactgaggtcttagggaaggccaatacattatttgttatacagtgtcttttgaggaacctgggggaaaattctctgttaaattttaatcccaagaatagttgttgtctcttgagccattcctatgtttttaatcttattgacagcgtgaagtgtgttattaactttttccatcttgtgttgactgccctagagctgagagccaaatttggggcccaaagggcggaatatagggcattataacgtggattttaaattctgttcccacttttcatttgtcttccccttatatttctttttccctttttagttaaaatataaacaaattctcgaaaattctaaagtcgttatgtctagcttgaagtgagatagatgatttttttttatttttccttttctaatttcttatgatatacataataaaagtaattagaaaaactcagtaacacttttaaaaattaatttaaataacgaactactaatataaaaatgattggaaagccaggttcatgcaacaatagaaatctatgggtacagatttcattttgtcattttgaattacttagacttatttaaaagattaaatgaatgtttattaagcaaggctccatactgagcactttcagaataatatctcatcttggagcagccatgtaggaaagaaatgtttattcccgcctctgtgggcgaataaaaaccaaaaaatagtgaatgatgcatcctcaaaaataccttctaaaggaaattataacatcgctacacaattaacaactgttaatttgctgctttcattttactatatggacctcactttagaaggcattgtatgcttttcataagtcatattattgataaatatattttacctatttttctagtaacaaaaataatgtacagtattttgaatcagagattttgaccatgaaaattgaaaatcataattcctttttttttttttggagatggagttttgctcttgttgcccaggctgagtgcaatggcgtgatcttagctcactgcaacctctgcctcccgggttcaagcagttctctgcctcagccttccaagtagctgggattccaggtgtgtgtcaccatgcctggctagaaattgataaatcataattcccatgcattttgctccaagacatgcttagagccctgtgagatggtatgatagtgtggcaagagaatactggtttacaaatagaagactcaagttattgtctatatagatgtatattgagtttgtatgtgtcaaactctgttctaagctttggaggtacaagtcaaagagctttggaatccttggcagcctcctaacttctggatatgaagtttctgcacttaataatcttgttaaacagggatggcgatacctgtttttcctaacatcagagtttgtgtaaggatcaaaataaatacggcttgagtgagtatttttgaaaagggcccagcatagtgtaaaaagaaggtaatattattgactgacaaagtatgacattttctactattgctgttgcgttgtactattgattactgttgatatagatgcaaatgtaagttgattaaagtataaattagatttgaagactcaaaaattaatgaactatgctgtatcttttttatttttattttttaaatttcagcttttgacaaagtttgacattttctactattgttgttgctgttgtactattattactattgataaagtaatagtagattaaggagtacatgtgcaggttcgttaaatgcgatattgcatgatgctgaggtttagggtacagatgatcccatcacccaggtagtgagcatgtactcagtaggtggtttttcagcctcttttccactcccttctaatttgtctggtagtccagtgtccattgttcccatctttttgtctatgtgtgtttaatgcttagctcccatttattgtgagaacacgtggtatttggttttctgttcttgcattaatttgcctaggataattactctaactccatccatgttgctgcaaaggacatgattccattcttttttatggctgtgtatattccatggtgtaaatgtaccacattttctttatccagttcactgttgaagggcacatggtagatttcatgtctttgctattgtgaatagcactgcagtgaacaagtaagtgcgttttctttttgatagaatgaattattttcttttgggcatatacccagtaggaggattgctggtcaaatggtagctttttaagttcttcgagaaatctccaaattgctttccacagtggctgattagtttgcatttcccaccaacagtgtataagcgttcctttttctccacagcctcaccggttttgttattttttgactttctaaagttgttattttagccaactgactggtgtgagaggtatctcattgtggttttgatttgcatttctctgatgattagtgatgtggagcatttttcttatgtttgttgttgcttgtatgtcttgtttagagaattgtatttcatgttttttgccatttttaaattggattgtttgtttttttgcttgttgatttaagtccttttttgattctgatatttgacctttgtcagatgcatagtttgtaaatattttctcccattctgtaggctgctgtttactctgttggtaatttattttactctgcagaagctttttagtttaattaggttcacttgtcagttttcatttttgttgcagttgcttttggggacttagtgatatgctttacttttaaactgctctgttgtcaagatttttcttttttcattatcaaagccaagagatttaatgaacacttggtctcattatgcactctataagggaatggttaggaggaggagcctggttgaagtctgattgtgccacttgctttctgactaaccttgggtaatttacttcagatctcgtttccttttctgtgaagtaaggataataaacgtctgtgcagtagacatttaggattgtatgggagtcagtaacatctatggaacacttacatattagtccattttcacactgctataatacccaagactgggcaatttataaaggaaaaaggtttaattgactcacagttctgcatgctgcggaggcctcaggaaacttacagtaatactggaaggtgaaggagaagcaagcacctcttcacaagatggcaggaaagagagctcaagctcaggagaaactgccatttataaaacatcagatctcatgagaactcattatcacaagagcagcatggaggaaaccgcccccatgaccaattacctcccaccaggtccctctcccaacacatggggattacaattcggattacagttgagatgagatttgagtggggacacagccaaaccatatcatagtgctttgcacatactagcagtcagtccatgctagttatgatgacacattcattaataacattactgaggttgtatttaaggtctatatgggcaaaatcctaaatggtaaattcttactttaaatttaagttttgagacacaatctctctctgttacccagtatggagtgcagtggcgtgatttcagctcactcaaccgccacctcctgggttcaagcaattctcatgcttcagcctcctgagtagctgggatataggcgtgggtcaccatgcccagccaatttttgtatttttagtagagatggggttttccatgttgaccaggctgttcttgaactccgggccttaagtgatctgtgcacctcggccttgaaagtgctgagattacaggtgtgagccaccgtgcctggccaaattcttactttatataacaacctcccaatgtataaggtgtattgtacaaaatagattatgtgtttttttgacaagtttgaaaaccagtaaattaatttatacaataaatcatgaatgatttcatgaaatttgtatgaaaaaatggtttaaccttatttataaatgtaactaaatgtgatgtagttaaaatacgtatttatttgatgtaaactctattattctattggtgtgtgcttgtattgattcttagtaattgtggattgaactcaaaatagcaaatgctaatcttgatataaatattttcatatttaatcataaatgagaatttgcattttgaatattttataaatattaatcaattaaacttcatgatcaagatattataaatcaaccttctggatgagtattaaaatttgccagcccatagaaaattctctgccttctgtattctaaaatagcatccagataggagtctttaatattaaatgttttttaaagtttctctcactttctttttgcttataaagaaatattttaaaatgtgtattaaaaatcaaaggaaggctcaggcagtttgtatctgtggacacagctgatgtaatcattggacaggattgaagtcaatttagtcaaattcgcaaccagctcaattaaaaacaacaccacaagaacagcagtaacagtggcttctgttttggtcagaattatcaatctagtggtgttgaagacaataaaaatgacctgatgatttgctttaagttgagaagtctaatagctaagtaagtgacacagtgtcatatgtaatgatatgtaatattcatcaaaagcacaaatatttgaaaatgttggaatttatttattccataaacgttttgtaatgtatctttatttccccaggcattacggacctgttgatgtacatagagaaaaaaatactatacccttccctgaagaacttattaccattctactgactgctttcttagacatattggctaaaatgtactgaaaattttaaattctttaaaaaaagtattctttttaaaaagtatactcttttgctaactcaagcttagagattatcatatttaatgaccatcagaaacatacatagaatctcttattttcttgtcttatgtgcaaaaatacacataaatgtagaactgcaaaatctggaattgaaaagagggatatacactgacttcgaaagcaaaaacagtataaaaattcttctaaattcaaaacttccaagttaaacttctaaattcaaaaaatttctaaatttgtgaaattaaacaatttgtaatttttagatgcgttgtttttaatttttaacttattttaaatttaaagggataatatataacatttttttatattttaagaaacatagatagctgtataacaaggttgttttcaagaaagcaccacataggtaagaaaatgttaactcctatttcttggacattaatattctgagttttatctttatcaaaaactattgagtaccattgaagaaaagaactttcttttgaaaagaaaagttttcaaatactatgagattgtatggaagcaaccagtttctgccaagtgagtaagtcagtctttatagatgcacctctacatcatagctttaaaaaataactaggcacctaccaagtacccagactttacctgttttccttttatcttttattatccttttatctttataaaaattccgtgatttggaatttttctcattctacagattaggaaactgtgacacaaataatttcataaagatttcataacagggctgcatagttagtaaatgatgaaggtctgtttgctccaaaacacttcttttccactggatcacagttctacaaaacagatcattgcagtgcagtgtctaggattgctgtgtttggcatgtgttattatatgtgcaggaatatctgattatttgtgcggtaataccattgtatagttgtttataaaaggaaacaaatagcaaacaactcaaatatcttacaataggaaatagtatacagtagtattacaataaggaagtagtataacaaatgaaatttgttattctatataattaagattttgcagattaaaatgtggatgtggaaatatatttttatttactgaaagatgtccacgatatatggttgagtaaaataagcttataaaatagacttataaaagagtcaattaaaaatttgtatagatacatagaaatctagaaagatactcttattatctaaattgtaagtggttttatctggctagtaggatcatagatattttcattttttataaaattgaaaaaattataaattttttattattagataaatacaagaaagcagttttttacttttaaaggaaaaatatttagagaacatgcacttacattattggataatactctcattgtcaccatactttgtgtcccatatcctttctacccacctaccccctattcttctgctaaacatttagtttattttcttccaaggctctgacgagattcatttgcatgtcggttatggtgacagaggcaaggaggttcctgctctctccctgttttttttttttttttttaactgtttaattccataataaattgtaacatcttgaagctcagccttttacaaccattttgtgtaaataaggctggccatcttaatgacagatacgtttacttggttgccacatatcttgtttgttttgaatgtgtttgcccagctttacaatctaagatttttttgccgatgcaggcagaaatcagtccctgtctttatttttctgatgatttactgattatcagggagagcaaaaccactgaagtcctttcctctcctatcacctaagcaaatattacctgttcaaaggaaaaataaaccttcattaagctaatagtcttgatgggtgtgtgtgtgtgtgtgtgtgtacacacacatgcctgtagaaccttaaaaaccttataattgggaaacgttaatggaaaacagattttctgaagttaaggtcagtaaatctggatttaagctctggtgtcatatattaattacataggaaaacctcctaattttcattagttctcttttctcatctaaataatgttgataattgtttaaatattacctacagggtttggggcatgattcacttggataatacttagtccttaatttatttattcaccatttgttctacaaatatatattgcgctcctattgtaaagtagatggtattctaggcactagatgtatctgtaaacaaaacagacaaaatccctgctctcttgaagctacattctagtgatagagataaacaatgaaaagtaagcatagtgagtaagaaagttaaatataattagtgtatctataaaagtaaaaagtatggttaaggaaaactggtactgctgtgcatagggcaggtagagttggggagcaggttacagtgttacatagggtggtcagggctggcttccttgagacgtgacatttgagtaaagactcaaatgaggtgaaggagcagccgtgtggacatgtcggtgagagtgtgccttaggcagaaagaacagtcagtgcaaaagtcctaaagtgcttgcaggaagcagcgaggctgccaggctggtatggagtgagtggggagatgagataagagaggtgaagtcagattgctcccaagggcctcgcgggacacttcaggactccacctttccctccgaatagacttcagctggtttaggattttgagaggagtgatgaaacctgattcaggtttgtaaagatcactcttggctgctgaatagaaactagagtggcggtgagagtgggaacagggagggggctaggggcttcttataggaatttaattaagagatgatggggcttatatgaaagtgagagtcagggtggggagaaaaatccattaaatacagtataaatgaacgttttttgtttgttgtttgtttttgagatggagtctcactctgtcgcccaggctggggtgcagtggcatgatctggctcactgcaacctctgcctcccgggttcaagcgagtctcctgcctcagcttcttgatagctgagattacaggtgtccgccaccatgcccagataatttttggtattttagtagagtgctggccaggctggtctcgaacccctgaccttgtgatctgcctgcctcagcctcccaagtgttgggattacaggcgtgagccacagcgcccggctatttgttcttataaacatggtgtgagctagagagtatccagttctcaaagttaccagtttttctttggggcttggaatttaatatagactgttatttaaacgtacatgttttgacatcatatgtctagaaattaaataggcatcttagtttaaattgcttttagtaaagatcttgtgagaaaatcaagtttcaagctcataaagcttgcttctgtgcttcttctgatcacatagcacacagtccaggggtgattcagtttgttctggcttgtttcagaaactgagaaaccattctcaatactactgtctctccatccctctccaccatgtaatccaagttttgtccattgtgttttcaaaatatatctaaaatctgttatttctctccatctccactgttaaccccatggtcctagatagacgttgtcagttttgtatactacaagtctcctcatccattctttacttagcagacagataattttgtacaaatgaggtctcattaaatcatgctgcagtgtaaaacatttcaatgatatccactagaatattcccatatgtccccatccattatctgcctttctttactctgtactccaagaggatacagaaacaaccctggaactcctttggcttctggcttccaactgaggatggtatacttccccttgatctagaacaaagtcacaattcaggacatggacaatcattgcaaggaaggctctgcgtgttttgctgatctacccatctcacttctttcgccatccctggctttgacagttgcctttcgttccttatactcccccgcctcctcccacctccttggtgtatactctcattattcctgatgaaccacttttcctccacctcccatccacttcacttggctcactcttgcttatcttgatgtctcaactttaacatcacttcctcagagaaaccttccctaattatatactcccattttcactgaatttttcttttgtagcaggtggtgtgactatgtataaatattcatgcaacattttgcatagtgattctcttctctcatagattctgggttccatgaggtcaaagatatgcagtatttcttttaaatctaagtctcagaagcagtggttggtacatacagagcactcactactgcctggtgaatgcattcagaaattaaatatagcctcacaggcagttttcagtaattgcgaggagattgtaatgtgttagtgtagagtcatatctaggagcacacttagaactgaaattagaactagcactggagcccaggagtctgtgtgttctgacctgaaacctagaaaccgaattcataaggctagcgatattatggaagacactaagaaccactgctaaagaaaatgatgcagcaaggtgtttctcatcttttaatattaaagttgaaagtgtttatatatgttttttcttacatatgcttattataacttttgtgactggtatgatttacttattttttctgactttattaagagcaagattccatacgtttaacaagtggaaataaggtaggaagagctttggccaaatatgtgagtgaagacaaaaagaatgccacatgccactaaaaagatttgaaaaccaaaaaaaacctctttctattataaataactttttattttagaaataaataatattctaattttttagaaagaataactttggttattaacatctttatttttaaattttcaacaagaaaattggttttgttggtaataaactactcttatatgtattaaatatttggaaatctgatcttaaaatttttgttgtaatgaaattttacctttctaccatctctactagaaaatgaaaataactaatctgtcagagtattattaataaaatgaaaatttactaatctgtccattttgtctactgattcatttagaaaagtttgaattgtatcctaggaaaggtccattactagccatttagaagaaagtcaatagatatgttattgaaatgcatttggcattctaagggtttcaaattatagagctgaatggaatttaactttatgaagaaataggctttgatggatatatttaatgtatttcaattccaacataagtttgatgcctgtaacattttagaaatagatgtgtttggtgaaatgttgacagattcttatttgtaagcagtgcatgaagccatctagaattttagtgactcccttttgatgagtgactattcatatttattcttattcattctaataatcagttttaagtaccaacaggacagtgtataacatctcagtctgatgggtccacttctgaaggtactagtctaaagttactgcattttggcacactgaagccagtgtgtacctgaaaagatgcctcaccttgatcatctaccttctccacaagttagtatgtgagaggaggctagatcttgtagcatatgtcattcttggcactgaaaagaaggtaatttgtgtaagacttttattgtgagatcttcaacatggaaactgcaaaacaaacttctgaaagagatgatgtgtaatgctgtttttttttttttttgtatgggtggccatgaaatgatttcacatttagtggaaaaaggcacagaatttgttcttgatacaaagagaaacttcctcaaccatttggctaatatatttggaaaacttagttctttaaagaaaatggaaaatccagttaacggttacttaccccatatctcctgcatcttgtcaagcaaggtgttacactcagtacattgatgtgtttggaaatgaaagaaggaatgttggatgtacatacatgggtgctaaaatggaggaaattaatatgttgaagaactgttttaggaaaaacatttggaaagtgtggaatctcaaagaagtatgtgataaaaaatccttcagtattgagaggacataaggcttgatgaaagttagtaaatcttaatttatgccaaagtgggtcactacaattaataccaaggcaatgaactgtgtgacgtattcatcagcattagtgggctttaaacttttgatgaaactcagaaattttaagaggtgagtagggaaaatttttagaattgtaataaaatatttagattagattattttggtgtgtttcatatgcatatgtatttggatagttagctacatataaattctatttctgaattgaattccatgaatttgtttcaagtactacttttaaagcagcgtatattttctgtgagtgataaaagaggaataatacgtgcatttttagaaattcaccgcaaatatggcaaacaaaacaatctagaaagggatttaaacgaaaaaaaaaaaccccaaaaatttaccatccagtagtaaaggtggattatgagagaccctgcctagagagtcataggagagcatggtcctattcagttagagccaccagaaaagtcctcacaaagaggaggtgctgaaatagactcgaaggaaaaggtttatttgtaatatgaagatgaagaggcagaggcatagaaggtggcctgcaatagtgacatagtgcatgcgtgcatgcatgagcaggaggtggatgggaggaaggaaaacaggtatctaaccaaatatttcacctgtgttttggtttttgctactgaattggacagaggctgtcaccattcatggtggttctgaaaaaacaacaaaaaagccactccattcctgattattactctaactagactgttgttgctctcccttagtttcagagtagttgtacctctgccacatcagtgaaaattatactactttaaaggagttttcttctcacttgttttacatttgtcacctattacatagctgtcctttgggcatctggtagcatctatgagccattggtacatttcttccttgataaatccccagtgtctaggataggccggtacatagcaggcatttgttaattacatgatgaatatttttggtaaggattctctttgatattttattatcaggtatattttatgttaaatgcaaataaaactgatcacaagaactgtgaccttggtgatagatagaattttcaaaatcatatggaacattaactttcattcatattaacattaacattaactttcattcaacattaacagcatatcaacatataatcaaaatatatatctttatttgttaagggtatgcagtgtcaaatggcaatcaggtttcttggtatatttgtttctgtgtttgtacttcatgcaatcataaactaggtaggcactttcttcccttgaagggttactaaattggaagattatctttctttggaatatgcttggaatgtattatcttaattattttactgaagaaaaaaaagagaaaggccagagagcttgtttcagtcctgtgattttttaaggttattgcctaactcaccttcattctctatattgagtcaggagttccgtcatctatgtatctatctatctacctatttatctagttatttatttttggataacatttattatgtaaggtactgtgccacgtttgttattcctcccagaacatttgttttatagatgaaaattgaggattcccttgctcaagaatatacagtgagtgagtgatgggtaggaattggggtagaaattatttatttgatgaagcgctcactttcaaagatgccatccagagatttattgtttaattataacaggttgggagaattagtaaaagttcttagcagtgagaaaacaaataaatgcttgaaataactgaacatgccagaaactagcagttctttgctttatctcaggagaaagaattattctggagagaactgcatttgataaaatgctggcaaaagtattaaaacactataaaatgtagtagcaataatataatctagggatttcagaaatgcatatgtgtaattaaagacacaacttatttgagaacttcattagaaaattagacactgttcctttctactccctttgtatcctcagagcctagttaagtgtctgccgtagaataggtgctctataaattcttgtggatgaatgaaaggatatttgagtaattttttaaattattattatactttaagttctaggtacacatgcacaacgtgcaggtttgttacataggtatacatgtgccatgttggtttgcgcacccttccactcatcatttacattaggtatttctcctaacactatccctctccttgtcacacatccggcaggctctgatgtgtggtgttcccctccctgtgttcatgtgttctcgtgttcagctcccacttatgagtgagaacatgcagtgtttggttttctgtccctgtgatatttgctgagaatgatggtttccagcttcatccatgtgcctgcaaaggacatgaactcatcttttttgtggctgcttagtattccatggtgtatatatgccacattttcttcatccagtcattattgatggacagtcactcatggcttcccttggctaggaaagggaaatcccccagcccttgctccccgggtgaggtgatgccccaccctgctttggcttgccctccatgggctgcactactgtccaaccagtcccaatgagatgaaccaggtacctcagttggaaatgcagaaatacccatcttctgcgtcaatctcgctgggaactgtagaccagagctgttccctattcggcatctttaggtgttgttttcaatgggcctcttggagaggtgacaactgagtggagtctgatgaagtaaaggctccgtatgcttgtgagctcaaatttatgtcttgaactttagacgctttatccaaatacctatcagatagcccatttgaatgtctcaagtagtattaatgactcaagactagaggaccaatgctgttaatattagtcacctgaacagaacccaaacatgaaacacagtttttgcacatatgaggaagaccacagtttaggggataggaaagatagatgcttgaaagttcgggtgactgtaactgcttatgcaataaagagctagctttgcccagctttactcagaagctattttcaccttaaacaaagtcttatgcttttctgtgaatgcttttcaaatcaattagaaataagggtgaatatatatgaattaatgctcaggactttgaaactaggtcagctaaagtaacttagtgatgtagtaataataaattctgcattattgaggagctgaatttctgattgtgtggtgtgtctggttttttttgcatgactcctctactttctgtatttcatcaccagtgcagttttatttccagtattctcctatgtcaactctgctggtcaacttagatgtcatgactttcctcaagtaccacttcggatttgctgctaacattgaattatatcatgtaggttgactatttttcttctcttgaacatatttctttattaaaatacaacccgtgttccaagttcaagcatacagtgtttcccttcatgatgcctttccagccattccgtatacaagttggtagtctttctataggccttcttgcatttctgtgatttttccattcataagacatttagttgttttgtttttctttattttctctttctttctttcctttcttttctttcttttctttcccttctctctttctctctttctttcttctcgctctgtcacccaggctggagtgcagtggcaaatcataggatcactcctgggcttaagtgatcctcccaccttagcctccaagttgctggactatagacacatgccaacatgcctgcctaattatttttattttttaaagtagggatggctctccctatgttttccaggatggtctcaaacttttggactcaagtgatcctcttacctaacctcccaaagagctggaattaaaggtgtgagccactgcacccagcctcatatggcattatacattgcttcaagtctaacagaatgagacttatgtctattatgacatattcctttgtcagtaatgcatctcttaacaacaaggatacattctgagaaatgtattgttaggcagtttttgttgtgtgaatgccatagagtgtacttacacaagcctagatggcatagcctaccaccacctaggctgtatggtatagcctattgctcctaggctataactgtacagcacattactcactgaatactatagacaattgtaacacatggtaaatatttgtgtatctaagtatataaaggtacaattaaaatagggtattacaatattctaagaccaccattgtatatgtggtttgggttgacacaaacatcattatgtggtgcatgactatatactcataacttgaaatcttatcttctggatttaaaattattttagggaaggacctaaactttatgtatcgttgtatctgtatacagcccagtgctgtttcttctatagattagtgctcagtttttccatagtattcttgttgtcacattacaggtaattgtttaatgcttatttgaaagtaatattggtctaattgcacagtaatatggacacactgaatacacacacatataatacagataaaatcttcatgcaattagagggcatgctttgtgttgactccctcttgtgtacctgtcacacctctagacttgacatctttgtgccagaggaaaagagagcagtagcggcagggatgtgccatatagttaattcttatcatctttagggcagtcaaggttgctctctgggttttttcctgaaatttgagctgaagtaagcattatagccaccactagaaagttttatattaacatttgcaagaacaaacaatgacagcaggcataagtcttattttgcattatacttttggtgcatcattgctggaaaaatatgctaatccacaccatttgcagctaccagatgtgccattgagatgtgcacaagttccttccagaggactacttgatgtcaaatgtcaatcattgtgtgttgaaatgacagcacctacatcaaaggacgaagaacaattacaattcatgttttctcgttaggctcacataccaagctgatgataatgctgtgataagttaaatataaatgacaaaatagaattaacaaaataattgtcagtctaccttttggtcagttccaaaataactatggaatctattgaagattatcttatcagtatatgtttatagtgggtgtggtgacatcctgccgtctaccttgcatttctttgctgtatgttttattaagagaattggctgaaaggatatcagcagatggtgatagaataagtttttcattgcatggctgagtacacttctaggaggtctctctccaaaatatgattgttgaagtaacttgttcatttgaatacactaagttcttcatccagattatgtcataaaaggcattccaccagtttagtagaactatggttttgtttcctttggctgggggagagaggatgagaggtgggaattggctcctttcatctgagattttctcatgttctacctggatctggatgtattacgtttggaaagaatagaaatcctttatgttccagtttcacatctttcccattttggcgccactgctaagaattaaaaatgcctgggcacagaagcagtttgagctgttgaacatacaggtaaactctgaaattttgttgatttctacagtattaatgagtaacagtgtttgccagagctagtacttactgtaagcttttccttgtgcaagaatgtgtctgagtggagggcaagttctttcctccttccgtcatttaatgcctgttctaaagttcctcctggacacgtatcactctacgtgaaggggctttgtgtggataccggagagtattttcttatagctcaggtattcttaaatatattgcaaccattgttacagaaaaaagtgtttatttttttattttttattttattgagaccgagtcttgctgtcacccaggctggagcatggtggtacgatcttagctccctcaacctccacctcctaggttcaagcaattctcctgcctcagcttcctgagtaggtgcgtccaccacgcctggctattttttttttttttttttttttttttagtaaagatggggtttcccatgttggccaggctagtctcaaactcctgacctgaagtgatccgcccacctcagcttccgaaatgctggggattaaaggtgtgcgccaccatgccccctgaaaaacatgtattttgtttaaagtcttctccttagagaatgggaaattccccttaaccctggcaaatgctgttctattcagattttgccaggagatgaagcattttttgttttagtttttttttaaataagctgctttgataaatatctaaaattgccatttggtcttataagtggtatatgacatgtactttaagtacagagtaaatgggagtttataaaggaacatgaatgaagagccagcttagttaaaacataggtattttctggataagtaggacaccgtaaatgtcaaaagaattgcactgttttcttttttgaatagcagtacccattggtaactcatctcacagaaataaataaagctatacttttattttctcaggaccaaggaatagagcttacaaaggatactatttttagcaatgttgcttgcctctgtatctttatccaggtcattccctttgcctagagaattgtcaggtccccacgcaatccctgagctcaacccctggtgaatctttactaattcttttttttttttttttttaaaagatggagtctcgctctgttgcccaggggggagtgcagtggtgcgatctcggctactgcaagctccgcctcccgggttcacgccactctcctgcctcagcctcctgagtagctggactacaggcgcccaccacgatgcccggctaatttttctgtatttttagtagagacgggtttcactgtgttagccaggatggtcttgatctcctgacctcgtgatccacccgcttcgcctcccaaagtgctgggattacaggcgtgagccactgcgcccagcctactaattcttaaatttaatttgcttctttctgggatgcctttcttgacttctcagggaagaattcgctgctgctccactctgcatcctcagcctccttctccacgctcagtgaactacttgtatgccatataatatcctagcatctgtctttgtcacctgatcgaagtccatgatatgttgacattggcttctcatctcctttctttttagatatatttgtctttggggcaaataggcatctgttagagtttgttgaatgactgaatagttttatatcatttttatatgtaaagttcttacacatggaaatcatctttgttatttttatcttcaaggttcatgagggtataaaattatggatcataattgcagaaaaaataatttatatcccttttaatattgagaaatgtaataatgtattagtagtgattattgttattgctaatattagacatgaaatattaatacattagtatacatttgatgtttggtaaagtgcaactaacttttcttttcatgttttagcccaattttcaatttgagtattgttatatatattttacattaaaaatttaactgattgaaaaccttgccagtaaaattgtatacaaattgcattcattgttttaaaaaaatgcttttaaccccaataacaggaaagactcttgatattttcatctgtagccttgcagacctttgaaaatgtatttatgtacaaattttaagtaaaaaggagatcacactgcacatattgttctttaactgagcatcacttttggttgaccaaattacacaaaacattttagggtaggagttgccatttgatgatcatctctgagatgatgctctcattgaaattagaaggtcaaccatatggggaggttaaaaataaaatcgctggccttcaaaatcctcttatcagccacctaacagggtcagatgctgacagtgatgctctgagagcagcaagtaaagacagattgcagaagttttcataattgtgacttgtgttctgttttactcatttttacttgtctttgtttccaatcttgggggtctctggactatgagttaggtggcaaatctcaggtacatctcctaaagactaatggtcatttacaaattcaaacatagataaagtatttggtgatatgtccatcaagtataactcagaaatcagtaaacaagtctttcccaaagtaagttccttctaaatgtagctaaaaagagccactttgtcattaaagtgatgaatatgcatttttagaacagacttgatgtttggattgtgttaaacatatgtctgttatgaaagtgttagtcacaaagataaaatttcatctaaaaataatatatagagaaaaatgcataaatatacacatggtaaaatacttctcttttctgtaaacttttagttctttataaggttgtgatatcatttaaaaatttttctgtattgaaagaaactggagacactgttcatagcgctgatatagtttggatatttgtccccacccaaaccttatattgaaatgtaatccttaagcggaggtggggcctggtgggaggtgtttgggccacgggggtggagcctcatggtttgagctgttcttgcaataatgaatactcatgggatctggttttttaagtggatggcacccttcccactctctcttgctcctgctttcaccatgtggcatgcctgctcctgcctcaccttccccatgagtaaaaggtccctgaggcctccccagaagccaggcagatgccagcaccatgctgtatagcctgcagaacttcttttctttataaattacccaacctcaggtctttatagcaagctagaacaacgtaatacagtagccaaagggtcgaagcaacccaagttccattgatggagaatggctaaacaaaacgtggtatacacgtgcacacacacacacacagtggaatattgtcaaccttaaaaaagaagtaatacatgatacatgatagactattgatgaatcttgaggatttatgctaagtttaaagaaaccagtcacaaaaaaacaaatactctctgatttaacttgttgaggtgtctagtgtagtcaaatatagagaaacagaaagtagaatggcagttggcagggctggggagagggaaaatgcggagttgtttagtggatatagaacttcggttttgcaagatgaaatgttttgcacagcactgtgaatacacttaacattactgaactgtacactttaaaaggttaagatggtaaattttatgtcatattatctcaccacaactaataaaagataaataactggagaaaaacacaatttttagagtaatttggactggagcttatttatttttagccatattgtttctaaagaataatacctaggactagtctttgggcctttaacataatcatcgtaaatacatgataacgaattcactggaaatatattagacaacattggttaagtttcagtgggagtcactatttgtcctaaattgccctattttatttatttttggtggaaaacatggacagataaattattatttgtagattaattgaaagctaactaatatactgaaatcacaatattaaatatgtatttagcagaaatgctttgtttttatggttatcaatttgtaatcaagaaagtattcatatatttattgactgcttactgttgtgtcagggattgagctgagttctgatattattgatgtataagttaaatcttgtccttaaggagtctgaaatcaattgcatttggaaagggagaataacacagaaatagaaaattatgctaaaaaactataaaactatggaagggatagtaagacgtgctccatgagaagagatagaaagttttgggagtttaggatttctggtataggaacactttatggaagaagtaataacttctttgggtggggagggaaaggtaaaggatatattatgacttgggtgagtaattgagcagttcaattagataaggacaaaaaaaggagagttttgggaaacacatccatatttattgaagttttgggagagaggaagaataagccaaggaaagtccatgggatgggatcaagagaggtccccaaactggaacctgatgaaaaaattaagaattactactgaatggcccacaaccaaacttaaccaaaccaaaccaccaacaaaacaaccagaagcaaaacaaaacaaaaaaaataaaaagcaaaatggagaaggagtgggtcagaatggaggaggaaaactgtgagtgtcatttcaggaaactaaggaaatgtggtgtgttagtcattttcacgctgctgatagagacatacccgagactgggaagaaaaagaggtttaattgatttacagttccacaaggctgggaggcctcagaatcatggtgggaggtgaaaggctcttttacatggcggcagcaagaaaaaatgagggaggagcaaaagtggaagcccctgataaaccatcagatcttgtgagacttattcactatcatgagaatagcacggaaaagaccggtcccaggattcaattacctctccctgggtcccttccacaacacatgggaattctgggagatacattcaagttgagattttggtggggaaacagccaaatcatatcattccacccctggccccccaaatctcatgtcctcacatttcaaaaccaatcatgccttcacaacagtctcctaaagcttaactcattccagtgttaacccaaaagcctacagtccagagtctcatgtgagacaagcaagttcctttcacctatgagcctgtaaaatcaaaagcaatctagttacttcctagataaatgggagtacaggtattgggtaaatacagccattccaaatggagaaattggccatgcagggcccatgcaagtccgaaatccagcagggcagtcaaattttaaagctccaaaatgatccctttgactccaggtctcacatccaggtcacactgatggaagaggtgggttcccatggtttgtgtagctccgcccctgtggctttgcagggtacagcctctctcctggttgctttcatggctagcattgagtgtcagaggcttttcttggtgcatggtgcaagctgttggtggatctccattctggggtctggaagactgtggctgtcttctcacagctctactcggtggtcccccgtagggactctgtgtgggggcttcaaccccacatttcctttctgcactgccctagcagagttctccatgagggccctccaagtttgctcatgcagcaaacttttgcctgggaatccagcatttctatacatcttctgaaatctaggcggaggttcccaaagctcagttcttgacttcgtgtaccagcaggctcaacaccatgtagaagctgccaaggcttgaggtttccaccctctaagccacagcctgagctttatattggccactgtcagccactggagtggctgggacacaagcaccaagttcccaggctgcactcagcaaggggaccctgggcctggccctcgaaactacgtttcctcctgggcccctgggccagtgatgggaggggctgccatgaaggtctctgacatgcctggagacattttccccatggtcttggggattaacattaggctccttgctacttatgaaatttctgcagccattttgaatttcttctcagaaaatgggtttttcttttctactgcacatcaggctgaaaattttgtgaacctttatgctctgcttcccttttaaaatggaatgtgttaacagcacgtttaagtcacattttgaatgctttgctgtttagaaacttcttccactaataccctaaatcatctctctcaagttcaaagttccacagatctctagggcaggggcgaatgctgccagtgtctttgctgaaacataacaagagtcacctttgctccagttcccaacaattcctcatctccatctgagaccacctcagcctggaccttattgttcctatcactatcaggtttttgtcaaagtctctaggaggttccaaacttgcccacattttcctgtcttcttctggccctccaaactgttccaacctatgtctcttacccagttccaaagttgcatccacatattgggtatcttttcagcaacaccccactcccagtacaaatttagtgtattattctgttttatgctgctgataaagacatacaggagactgggaagaaaaagaggtttaattggacttacgttccacatgtctagggaagcctcagaatcatggcgggaggcgaaaggtacttcttacgggtggcagcaagagaaaacgaggaagaagcaaacgtggaagcccctgataaacccaccaatttcgtgagacgtattcactatcacaagaatagcacgggagagaccggcccccaggataaattacccgcgccccaccgcggtccctcccacatgtgggaattctgggaaatacaattaagttgagatttgggtggggacatagtcaaaccatatcacagggtgttttaggaatgagcagaagtcagtgagcataatagagaaggatttggtgcaaggtgctgggtgatgtccttgtggagagcaggtgaagagagctaggaggccaggcaggctgaaggtgggtgctgagctaggcagacgtgaagattgtgagtgaagacaaccatttcaataacttttactataaggaggaagtatagtagcaagaattatactgtggaggaatctgggttttaggtggttttaaattttatgtattttattaaaattttctattgtaatgagagatacatagtataaatttaccatttaatcattttaagtgtacaatttagtaatattaaatatattctcaccatcatgattatctattccagaactttttcatcaccccaatcagaaattgtgtacctattaagcaataattcccattcctgtcctcccttcagcccctggcaacctctaaccttctttctgtctccatgaattggctatcttaaatatttcatataagtggaatcatacaatgttcattcttttgtgtctatttatttcacctagtgtaatgttttcaaggctcatccatgttgtagcatgtatcagaactcattcctttttatggttgaataatactcccttctctgtatatactgcagttggtttattgttcatctgtgaacattttggttgtttctcccttttggctgtggggaatagtactgcttgaacattgttgtacaagtatttgtttgaatccgtgttttcacttcttttcagtatatactaagagtggaattgctgggccatgtggtaattccgtgtgtaggttttttttttttttttttttgtcattagaactccagatttttctttaaaaaaaaaacttttattttagattcaggtacatgtgcagcttggttatataggcaaacttgtgtcacaggggtttgtggtacagatatttcatcacccaagtactaagccaagtgctcaatagttattttttctgatcctctcccctgtccaccctccacccttaagtaggctccagtgtctgttgttcatctgtttgtgtccagtgttctcatcatttagctcccacttataagtgagaacatgaagtatttggtttttgttctaggttagtttgccaaggataatggcctccagctacatccatgttcccacagaagacagatctcattcttcttatggctgcaataatattccatggtgtatatgtacctcatgttcccatccaatcggccatttatgaacatttaggttgattccctgtcattgctattgtgtatatgctgcagtgaacattcacttgcatgtgtctttatgatagaatgatttatattcctttggtatatacccagtaatgggattgctgggttgaatggtagttctgtttttagctctttaagaagtgccatccaataaatggtgctgggataactggttagccatatgcagaagagtgaactggacctctttcttatactatatacaaaaatcaactcatcatggattaaagacttaaagtaaaacaaaactataaaaaccctggaagacaaccttggcaatgccattctggacatagaactggcaaaaatttcatgacaaacatgccagcagcaatcacaacaaaagcaaacattgtaggtgggatctaattaaacttaagagcttctgcacagcaaaataaactattaacagagaaacagacaacctacagaatgagagaatatttgcaaagtatgcatctgacaaaggtgtatatccagcatctgtaaggaacttaaatgtatgagaaaaacaaagcaaccccatttaaaatgggcaacataatgtttaactctttgagaaactgccaaactttttcccatagcagctgcacattttacatccctaccagcagtgtaccagggttgcagtttctccacattcttgtcaaacttgttattctctgttgtagtgtacctacttcttcttcttctttttttttctttgagatgcgtcttgctctctggcccaggctggagtgcggtggcacgattttggctcactgcaactctgcctcctgggctcaagcaattctcctgcctaagcctcgcgagtagttggggttacagcacacaccaccacacctgtctaatttttgtatttttagtagacacggggtttcaccatttggccaggctggtcttgaactcctggcctcaaatgatcctcctgcctcggcctcccaagtgctaggattacaggcctgagccaccatgctcgactctccttgtggttttaatttccattccctaatgactaatgattgcagacatcttttcatgtgttgtctatttgtgtattttcatggagaaatatttattcaagtcctttgcctggtttttgattgggtgcttttttttgttttttttgtttgtttgtttttgctgtagagttggagtttttataaaatagatactagagttggccttatatatgaaattggcttttttttttgcaagcccattttaggcattgtctcacgtcatgataatggcctttgatcaacagaaatttaaattttgatgaagttctgtttgtctttttttcctttggttgcacatgcaatttttaaattaaaagtaaatttccagtaaaatttcttgttttggagtgtaaagctatgtggattttaacacttgcatagatttgtgtatctacaccaaaatcaggatacacccaaatcaggatacagaaaattttcatcatcctccaaaattctttatactcctccatttgtaggcaaactcttgatccctggttggcaatgacctgttcttatccccatggttttgcctttccaaaaatgacatataaatggaaccacatatagtgagaaattctccatgggtctcgcattgctgcatgttttacaagcagggacactgactgtttttttccagactatcattttgagaatgtttgaatagtgaatagccttggaagatatagtatgttctccctctgaagcaaatgggaggcatactcactgcccattataaaagatttgagtttctgagatagggttcttctcctgtaacaagtcatggtatgtatctcttggttctcttcacttgcccttttggaattggggctcagggcaccagcactcatacaaaagtgctgatagtctacgaattctgttgctgtcaaagagaggtgggagggaatggatttggcagtttgaggagctggagaagacttgaaatagttgtagaaaatgagagtaagtgttactggggaaatgtggattatatattaagtaaaacaagctggttgtagcaataactagttattatttttacagatagcaaagaaaaaaaaccagaacaaaccaacaagcctttttaatacatctccttatgatacataaacttacaatgttgtttaaatggacatcagcagtgcataaataaaataaacctaaatgttgtttgcctttagtgaatagataaattgcttatctttaacatgtcatttattggaataacaattcttataattcttttgtcaaggctgtcaaaattgtcatttaaaatgcatagccaaacaatattatgccaacaataacagaaatgagaaaaggaaaacagctatgcacagtttgcctctaataaattacctgttttcatgtgtttatatgcattcctagtctttgtccacagcaaatattatgatattgaatcacttgttagttgcatcataggcacaatttaatttactcttttttattaacatcattttataagcatttttttacatattattcctggaccttaacataagactttctaccatctgggcttttgtgtacttccccgtcaccccaccattttatctactctgggaaaggcattattatctccattttatttatgtaaaaaccaaggcttaggaaattaaaagatttgcctaagataggtgtgttgcatctctcagggtaaaatctttacaagtataagaattaatatatttaccttattcatcattggttttcatttgttttttattgatacatttttacatatttatggagtacaagtgaattttttatacatgcttgtaatgtgtaatgataagtcttctagctactttgaaatgtgcaatatattgttgctaactatagtcaccctggttgctttggaacattagaacttcttcttaatgtaaatttacacccaaccacaaaccctcttttatctccccatcctaccctcatacccttcccagcatctgatctatctgtcattctatttctatctccctgtgatcaattttttaaaaaactcttatgagtgagaacatacgtaattgtctttttgtgcctgggttatttcacttaacataatgacctctagtttatgtccatgttttgcaaatgacaagatttcattctttctgtatggctgaatagtattccgttgtgtatgtgaccacattgtctttatctttttgcccattgatggacacttaggttgattctgtatcttgctgttgtgaatagtgctgcaataaacttgcaagtgcaggcttttgataaggcaagttttttgatatactaatttcttttcctttggatagatacctaacagtgggattgctggatcaatgatagttctttcagttttagaaggaatcttcatactgttttccgtagtggtcatactatttacattcccaccaacagtttataagagttccctttgctttgcatcctcaccagaattgttatttttatctttttaaaagccattctaactgggataagatgctatctcattgtggtttgatttgcatttccctgatgcttagtgatattgagcactttttcatatatctgttggacttgtatgttttctggcaaagactgttattttttctccccataaacatcagctaaaaccaaagctgagattatgaaaaactctgattattcaggatacatgtgtcttttactgtgtaacaaccaagcaaaagaaatatacattaatagagtagccagtcatatttgtgaagaatgtagaactctagcaaataaattttcataatatgtaaaatgacaacatagatttgatctgtgatgaagagtttttcattttatatagtgtttatagtcttttaaacacacacactagtggctaaacaaatttggccacatattccagtgcagctgtgtgtatgtgtgtgtataattatattgtgctactttattaaaataatttatatattatatacaactatgtattttataaaaatagattaatattaatatgaacataatctctaatatttcatctatttttacagtgttttttctgcccatttctgggatgggtgccccccaacttgtgtaaactactgatgaaaaaaataacaaaatgcatcttacatatttagacactttaaatatttgtttaatgtatacaaaggacctttgcactgaaagctatttattgagttcacaaatgcatgttgaatatctgttatgtacaagcattttgtatagatagtgatctttctttagctctatgcaagatttgactttttttttttatcagtaacctcttgtaaaatctgattttgacctaatatctagctaaagttccaaaagttgtccttgagagagtgcctgaaattataaaagtagtatggctgggcgcagtggctcatcctgtaattccagcactttgggaggctgagacaggcagatcacctgaggtcaggagttcagaccagcctggccaatatggtgaaaccccatctctactaaaaatacaaaaacttagccggtgtgttggcgggcacctgtagtcccagctactcaggaggctgaggcaggagaatcgctgaacctgggaggtggaggttgcagtgagctgcgatcttgccattatactccagcctggtgatagagcgagactccatctcaaaaaataaaaagtaaaataataaaaaaaagtagtatggcagcatcaaaattacttgtaaagcagtgtttgttaaggctttgtactcctcacttatcattgtataatatttaatttgcctttggaaaagtgaatatggtgatagtttatcctagagttgtttgtgctgatgttttggcattttcaagaaaaacacaaatatgtaaaatgtaatcagtgtcaaagggaaactgacaaatggctctttgatctcaagtaaataacagcttctaaaacagatgtatatgtcaatagcctgaattttcttgaatatgtttctgttttgactcctttgtagattgatttgttccacagcaaccaccaggtagaaatattctaaagggcaagaaagaaagggatatatttggtgtggagattttttttttctttttttttttttttagagacaaagctcactctgttgcccaggctggagtgcagtggcttgatctcggctcactgcagcctccgctcccgggttcaagcacttctcctgtctgtctcagcctcccgagtagctgggactacagtgcaagccaccatgcccggctaatttttgtatttttagtagagatggggtttcactgtgtggctaggatggtcctgactcgtgatccacccaccttggcctctcaaagtgctgggattcaggcgtgagccaccccacctggtgtggagattttaagtgacttttgagtcagagcagtagcttttttccttttcattctagtaattatttaagaatgtttaaaatgtatttttgtcatatattttaagtacactaataaattttttctgaattgtatgcttctgttttttaattgctgaatagcttgaatttcctctcctgaaacaacctcaaattcagtttgtcaaagtcagaaacataaacttcttcctcaatgggttctgtcaatctaacagtttagcagaggtgattataagctcagttccaggcatataaatagattatgagaataagatcctggaaactgtttttcatgaacccagctgctgctgtattaggtctgcaataaactgaaaatgacattttccatatagcaggtgaatcaagaacataaacattctaagagtgttttacatctttcacacaccccttcatcactttaactggattagtaggtggtagcttgggccaatagtttaccacctcatgcaagctgacttgatttccaaacattttattgtctcttttggaaagtaggttaatacacgtgcccaagaggacccagagcaagaaacaagcactcaatggacaagtcatatgaagcagggtagagcacttaccatcatactcatacccatgggcctacaactgctctttcaagtagatgggatgataaggcagctattaattgagaattgacttgaagcagctttgctcagatctttgccatattatctcatttattaatctcaggataatcctacattagttacacttataacccccttttataaatgagcaagctgaaacacagagagggcaagtcacttgttcgaggtcacatataaatggcagattcaaaataagaactcagactttctgaatacagagctgcatctactacctctcctgcctctcattttggcaataaagtttttggcagatggtgatcacagaagttgctaaagtcacaacttttaagtactcttttttctaaagtcaaattgtatagtttttatcctaaaaattatattatcacttttgtagtttagaagaggaaggtgtgaaaatttgaaatgtttctattctcatttaatttcctactttccgtggagagtattccatacccagattaaatgtatttccaattgttgctcacacttaccaaagggaaggtctctgctcagttttgagcagagctccctgtgtaggagtatgacagtcctcagtaaagttttgtcacctatgtttggcaaaaatcctgggcagatgagcgattcatgtggcaagagcactgccaattgaaaaggtgcattatatgaatattagcacctctaagtgtttgtgaaatagcaaaggtagaaggactagaatatgacaaagcattttcaaaaaattatactacttctaatagcttaacatgttgatagaaaagcgattcagtgtagaagtctgtgatgattcaattctaagttgtatgtaatagagctaaagctgtaattatattttagaggagtattaaacaatataaacatgatctctgagtcataaattcattattacactgagttttaaatataattcatttataaccatataatagacacataatttactgtgtgacaagaaatactcttagatgtagcaagaaaaaatggaaattacaaacattgtgatttcaaaataattcttaacatttcttcaggggttattacaaagcaaatgaaaggatttttacaaggtgtagttcagttgcagtttccctcctctgtattcacattattgccacgcttacgaatgacaaacatttgtggactatggcagcaatctgttgggtgtttcaatctatttgagctgaaattgattagcactttatgaaaagtgtacagaaaattaccatgcttatcaggcaaatcaagccataattctgcctttttttttctacacctgcagctatgaatatttttggtgggtacattgagacgtgctcaagaatatacatattggactgcatatcatgcaattattctgatcttactgacagtttgcaaacaaaaactcaaaacaagatgcaactgtgtgcactcctgaactgtaggttctgattttggcatccatgaatgcacgaggaaagggggtgcagtgaagaggtgtgcttttgctcatcttacagtgaaatataatctgggcatttgtttgatgatttcatgaaatatggaggaaatctgaaccaagggtttcacctgattgcttttatttgcccacctcggtaataataataagtgaaaatcagctggagttgatgactgtggagccataattaaccatattgaaggagaatcattaagaatgaggaaaggagaaagtgggcaatgatgggatcttccttttttgagaagaagatacccacctctcgccagtcaccccctgccatggcatctttcaaagaaaagcaaatattgtaggccaaaataaaaagaggaagaacatggactacttgggctccttgtttgagtgggtgtttaatgtagaaaaatggtgtagaaataggttagttttatgctgtcgctctgggcagacttgagaataaatataatgagattaaaaaagactggggaccatagcatagtgcttggcacacagtaaagtccccaagaaatatttgctgtttgattttaaatatatttatacttttatctaattctcttgtggtgtcaaattctttataactaaagctttacaaaaagtactatgtattcttttctgtatgaccttatttatgagattcctgtcatttttggttactgagatttactgaacaaggtgatgttcagcataggcaaatatttcttctttcttctttttttttttttctttttgagatggagtttcgctcttgtccagactgggtacaatggtgcgatctctgcttgctgcaacctccccatcccaggttcaagcaattctccgcctcctcttgagtagttgggattacaggcacgtggcaccatgcccaactaatttttgttttttagtacagatagggtttcaccatgttggccaggctggtctcaaactcctaatctcggtgatccatcctcctcggcctcccaaagtgctgggattacaggcatgagccaccacaccagcctcttcttcttttttaaagtaagagctggatctagtttgttttcagccttcatcttgtatgcttgatgtttgtttgcacacaccaaatccaagtgtaggattctagaatttaggttatgttttgctttgattttcataatggtactagtggctaataacttcagagaacattctcagtgacttttgagttctttttttgctattatttctgatagctatgagcacattttacagagatataaattatatgatttctccctaagtgtatttgccttgcacttgtgtccgtatgattggcctcagtaagtagaatgcatgtttccataggaactagaataataacttgatatactgtgcctagtgtttcattgttccatgaaaacatttgcaaagcaaaagaatgtgaattatatgctaataatctatcaatttttgctttttaaaaatgtgtctttttgaaaagctgcatttactccaagtaaacctatttctcttcttcattatttttgaggaaaaattgttagtagaattattggatttttcacctctcattcctctattatataagtttatgaaaactaaatgaaaaaatgcagtgaaggtaagattcagtgccaaatctctccaagtgtatgtacctccatagcttcatacagacttctttacagcataaggctactatttatttttattgttcttgaaatagtgtataggttgggtttaattttattgacactcctttttaaaacaattcagactgattcagaagagacatcttttgcatcagagaggactaaactatgcaaagtggcatcttttgaaaatgcttattaccagagtggtagcaaggaattttgctcaagcagttcctatagtgattgaaactggctcacttcccagctcttaacaatttcagcgtgggtttttcttgattgaccatagtcatcagcatctctgaacatatacattacacacacacatacacactcacaacatacaataaacacacttggccagacataaggtaaacaaacaaaagactgttattgaagtcgaggacagcttacgcagagcaatttaatctttttgcataaataagatccctattctgttaagcgttttggaatatggaaagcctataaatgctgacttttaattttgagaaatcagaatcaatgtagaatgctttctagtggttcaaatattcagggtctatgactaatcccaccctgtttcttcatagattctttatagtttaaaacacagactaagtattctaaaactaatttgtaacgcctcttccaaatttctgggttgttggctcatttattcattaactccatcatctactttgggacatttcctatatgccaggctctgcactaagcagagtgtcagaaaccttcctgcagtaccccctggctcattctgcctctgtaccactccttcatggcacagccatgggcatctttagcaacacagatttgatcacatgaccgtcctgcttaaaacttttcaaggaagtcccataccattttcctaaatttcagagtctttgtcatagctcacagagtcttgtgtgatgtggccctgccaccctctcaaacctcatttcattgtatttcatcctttacccattgaattccagaacactggccacctttctgtgcacagatgaggccaggatctttctcagttgagcctttgacggtgagcttttgctgttcctcttgctaggatattctattccctgttcttttcaaagttcttccctttcttcatgtcttatcttgtgacatttaaatgtcactccttgaagattcttccccaaccactatgtaaatgggccttccctgcaactctcttttgttacattgtttttctatagtacattaacagttctaaacatacatttatttgctttgttattttctgtctcccccctacagaatgatgttgggaaggaatttatagacagtgccaaaattatgagattgaagctctatccaattgaggagcaggtatagtgggaatgagcagttgagagagccagaaagataaagattgcagccagatgacattagaaaattataagtgtccagcagttcttagaacaatttgggggtgagactatgggtgtaagaggccaatgtcaagtggaggggaagtgaggattgttgatttgagtgtccaccatgtgtgaggcttcattaggcacttggtatataagtctcagttatgccttcaagtgctccagacttgtctataaaacaaaatccggtgctcacaagctgccaaatacttttatcattctaacttgattctccaatgatgccatttagtaacctcctacctcgccacattcttctttgtaaatcctgtttagatctgctctatgcctttcctttttctctgctaaatcccatccatcctgtaagcatcaactcctggaagtcatttctaatcacctcttttgcactgcccccatcccctgttgtgtcatctgtctctcccctaaacatgcagagttgtgctgcctccttttgtctgtgctttcactgtattttattctttgtctcacagatcttatttcccaactagacttaaacaccttgagtgtgtaatagtttctcatatgtctttgtaatatgctcaataaaatatcttaggaaagacatggggaaaatatttgatcatggaagattaaggaaatttttctcatgtatagctgctaaataaaaaccaactacatagtatagaatggtatatatgctaatacgtagccaattaagaaattaaccatttgactgctttgtatataaaatgatgtagtgcctgttatttcagtaagaagctgatggagagggatatgttagatgtttaaatgcatagttaaggtattcaaggttaaaccttttttttttttggtctgaaatatcagcaataagcttctaaatttttatggctgcttttctgtatcactttatcttatgtgaaatttcagatgatttatctgtaataaacatcatcatctgacatggctgaaaacagtactttttgttcatttgatttttggataatgcaaaattatagattttttaaaaattatattcaaagaatactagtgcaagacaatctttctaggttaaaaaatatcttataaacctgaattgtcaattattttgtatcccagatgtatggaagttaatggatagtcagtaacatacaggactagcagaagtttgttgttataggtaatctggagagaagccaggtaagtggaatttgggatttgctgctttgccagaaagcagcacagagacatggtaagtggcaagacccaggtaactaaaacaacctgtcttagtccttttatgctgctgtaacagaatatcacagactgagtaatttataatgacagaactttatttgtcttctggttctggagactgggaaatctaagagcgtggcattgactatggtgagggcatttgtgcctcatcatcccatgacagaagatggaaatgcaagagagccaaaagcaagagagcaaatggggccaaacttgctttttataacaagccactcttgtgatatgaaccaactcaaacaataaagacataaatccattcatgagggcagagccctcaaggagaatcacttcacttcttaatggcctcagcttctaataccatcacaatagtaattcagttcaacatgggttttatagggacgttggaaccacagcaaactgtaaccattttgatttcctatttgcaccattttaaaaaaacctatttatttaacggctgtttattcagtgcctattctttgtgttggagactagaggtaattacaaagggaataagacaaacagtcacccactctgggatgcttcccttatcttcataatgcatttgatcctgtgattctttggcacatgagtccatgcatcttgcatattagtgtccagtaagtttttcctgaccaattgataatatagatataattggtagcagttttgtgtatatttttatagttagatgttgttggcacatgtgacttgttctcagaaaaatacagaaaatggttaaagacaggaggatactaccctgatttctctgttattaaagaacagctatttggggggaaaacctgatacaattatttgagcatgtggcttaagattagacctataaacaattcaggagcatcttccagcaaactgtgtgagaattcacagaataaacctggtaggtttgtgctatgttattcacatgggctgttaactcttttccattccaggtcctttatttccctgccctcctcaatctcatgctcttgagatttttaactatattattctttacaaagtcatcttcaaaatgattcattttggatagcaaactatccctcaacttcctacacactctcactcatactcacattctctcttatgtctttctgtgtggaagggaactttagaatgtctattctttgtgatgcaaaaatgacaacacactgatgatgaaggggggttttttaggagaaaaagtagcttttcttttcatcatactgccacttttgagattctatagaagaataggtattgaacacagaccacttggctctctgaggtatgctttggacacacttaaagtcagctagaatatgccttctgtttaaggttggagtctgcatttaaaaagagagaacggattaattggcaggtaagttgagattccatgattcaggaaacctttaagacttttaaggcaggctctttgtaggttggaatgaaacttaatatatatatatgttctttgattctttcgtacagttatatagttgtcttctgactgtgttatattggttggaatattaatatgttgctgtggaattcacatatggtcattgtccagtagtgacaaaatgttttaattaatgtggctagttctcttatttaatttataaaataaatattttctttattatcttacttcagagaaaattttatgctttaactgataccttacatctgaattttgaaaaaacaagcatttttaccgccacaatatcatactgtttaacttcaggtttaccataaaaattattttagctgttcttcacaccacattgtttcccagaagtagctaaaactgccgttattcatttgtgtttttgagatatattattttaccttagattctttgaaaaactctgtatgctctactgatttttgttgggaaaaagtgtgtatttcatgacacagttctccagatataatggacattatccaaacctgaaaagagtaagattgtagaatgctccaaggaagcttgaaaaccaagggggagagaaggtttcacattttcctcatgtactttggttaatttttcattatatctttatttatttttctcttttttcttcagttataatatgtcactttgtgatcagaggagatataaatctcctcagggttgtctaacattcaacatttagtcctaaaagccaaatcgagtccagaagtctaaaatcctgcttgtttgttttaaacaaagtagagtgagagatttcgagagaaaggaaaaactagagtgacgatagaacagacaatagaactgaagaataagatggctcatttcgatctccagggggtgggattttcctcatattggtgaaatatttagttaaaaccacttcatttttaattccatgtcttcaaaacacttttatatctgatatcttgtttttgccttaatctatgagtaataaatgtacctaccttattaattaaaagacaaagagaatgatattgaaaggatactaaagggcctacctaaatgtctgtaatgtgaaataaataagctgtttaatttttgactcctaaactactcttttctgccagttttacttaatatatgtgtatttcccacttgtgaggtgattgaaggaaaccttgaactatgctacagccattcagtaagaaattctctataaagagtggcaaataattcagattattagaatgttgctgtctttatcaaagtcaaagctaattttgttttataagccgccaaaagaaaatgcttggggaaactctccaggacatcggtctgggcaaagattattgagtaataccccataagcacaggcagccacagcaaaaatggacaaatgggatcacacaagttaaaaagcttctgcacagcaaaggaaaaaataaagtgaagagacaacccacagataggagaaaatatttgcaaatgacccatctgacaaaggattaataaccagaatatataagagcttacacaactctataggaaaaaaaatctaattatctgattaaaacatggggaaagttggaataggtatttcttgaagacatgcaaatggcaaacagacataagaaaaggtgctaacatcattgatcatcagagaaatgcaaactacagtgagatatcatctcacctagttaaatggcttctatccaaaaggcaaataaatgctggtgattatttggagaattggcaaccctctacactattggtgggaatgtaaattattacaatcactatggagaacagtttggatgttctcaaaaaactaaaaatagagctaccatacaatacagcagtcccactgctgagggtacagaataccacccccctccccgaaaaggaaatcagtgtattgaagagatatctgttctcccagttttttgcagccctgttcacaatagccaagatttggaggaaacctaagtgtccgtcaaagatgaatggataaagaaaatgtggtatttgctagtcagccacaaaaaagaaagagattagtcatttggaacaacatgggtggaactggtggtcattatgttaagtgaaataaaacagcacagaaagataaacctcacatgtcctcagttatttgtggaatctaaaaatcaaagcaatgaacccatggggatacagagtagaaggagggttactagaggctgggaagggtagtgagggacagaagggaggctgggacagttaatgggtacaaaagaatagttagaatgaatgaataaacctagtatttgggccaggcacagtggctcacgactataatcccagcactttgggagccaaggtgggtggataacaaggttaggagtttgagaccagcctggccaatatggtgaaacccatctctactaaaatacaaaaaaattagctgggtgtggtggcacacacctgtagtccagctactttggaggcggagacaggagaatcgcttgaacccgggaggcagaggttgcagtagccaaaatcacatcacagcactccagcctgggtgacagagcaagactccatctcagaaaaacaaaaacgaaaacaaaaccaaaccaaaccctagtatttgatagcatgacagggtgatatagtcaataataattatacattttaaataaaataatataattggattgtttgtaacaaaagagtaaatgcttgaggggatggataccccattttccatgatgtgattattatgcatgcatgcctgtctcagaatatctcatgtaccacataagtatatacatctactacatatgccaaaaataaaatataaaaaaattataaatacaatttaaaaacacttgaagaggtaaggtaggttatgtatggtataaaatcttttagtgaaggtgtgtcaggatatagtttgtacaagcagggcatctggtatttgagattaccaagctaaaaccatctcagtttgtgagaagtggcccaatcaaacagaaagccctcttttctccattccatttttttttcttcaaagctgtcattgctataagttatattcagtttaagaggtgctagtcatagtttgttgggctaaattttgcatttgtactttattctggcagacaaatgagtttaatttggcttgtttagtatattttgaataatttttaatacaaatattaaaaagtaagtaatggaaggggaggtccatttcatctggttcgaaaattggactggtatattcttttagtaagtgtggaatttttaaactaattacgaattaacccataattggggaagataaagatctgggaaaagctggaaagttggtttagtgaatgtcagttgctcctggagtcaaataacctaaatttgagtcaacttattatccagtgccttaggaatgtcatttaaattatttaagtatctgtttccttatctatgaagggagaggagaacacctacttaaaaggacaggaggtaatattttaaaggcagttcctaaattgtacagtttaaatacacataggtatgtttattaagtgaaaaggcatttgcaatacatggaatctaaaattatatcagtaatttaaatttaatttctaaagttatagctgtaaaacaagtatctcctgtatcagctctgggcaacaacttccccaggtgatatttgagctgaatgagctcaagttgaattaacgtgatatctcaatgtagtgtttcttgggttgattgcagcaactctgagtgctggttctcaggcaagacctctttcttatcttgcagcttttaccattaggagatatatacctatcttgccttacattaagaagagtatcttcatgtccctttctgagctacacacgagtgatttagtttggatttcattctttcagaaaagtgtagccatttgcttgctgcaatagacttttttccctccgcagccttcgctgcaacacagtgggtcatgtctaaaaaaacaagggcctgttttataatcgctttgattttttcaggaatagcacccacagcagaaagaagtgacttgttttgcagattgtagatgtggcacatttattcacatgtattctgagtagtaaagtttaatttttcaaaactactacttaagccttgcaaccttttgcccttaagtctctaggaagaagagttaatttgactagtactgaattatataagaaagtgttctaaaaactcacaagtcactttaatgtatttggttccattcaaaatctgtttactcattcagatatatgtgaatattttaattatgcattgtttttaaagaaatatcttagactgagtatgttataattaattattaaaaaactatattatttcctgagtattgtctccaactgaagaattccacgtctttttcatgctttgaatgtttactaccaagccatataacttcatagtaattagttaataaatttcttttctgtgttcgaattcttataatgagattagagttataaagtgaagtttattttatttacttatttatctacatgaggaagcttgttgactgaatataaagacattattactgtcgattttttttttttttttgagacagagtcttgctctgttgcccaggctgaggtgcagtgcaggatctcagctcactgcaagctccgcctcctgggttcatgccattctcctgcctcagctcctgagtatctgggaccacaggcgcccgccactatgcccggctaattttttgtattttagtagagatgggttttcaccgtgttagccaggatggtctcaatctcctgacctcgtgaccacccgcctcagcctcccaaagtgctgggattacaggtgtgagccaccacgcctggctatttctttttgtatttttagtagagacgggctttcaccatgttagccagggtggtctcatctcctgacctcgtgatccacccgcctcggcctcccaaagtgctgggattacaggcatagccacggcgcccagcttactgtcagatttttaaatgtgatttacaagcagcttggctttacttttgatggcctaactgattttgagaattatcagacatttaatgtatgaatctttgcagtggggaaatgctatattattttataacagttagtatgacctgctttttgccattggttagtagtaaagacctttttgtaattaaaaagatagtaatcaattagggggaaaaggtatgtgtcattattcaaatagaggagacttgtaatattggaagcagatggtgccaggggaaggacttacagacacttataggtgcaataggttatagtgccccctcccagcattttttctaatagcagagttttttgtttttgtttttcctatggaaaaagaaatgagaatatctttcagtctgtgtgatttggcttcagagatcttctcaaagataaaagataatgagtttaaggtactaaaaaagagcagggaaagccattatatttatgtggaattttctatttttggtgcaggtgaacctctttgaaggtttgccattaagaaaaaaaaaatcccaggggaaaagtagggacataaccagtatcatgacaagtaatctctagtgtttcgaagtgatccatagggcattatttaagggaaatgatcacaagctcagaacgtagtcatgttcttctggtgtgaaactagaaatgggaactgggcgagggagggaactggagcattactcttaaagtcttagggttaaacctcaaggtcttatagagacatttcctgttcagttcagctattcacttattcaacaaatatttctgagcatgtacaatttgccatacactattataggtgaggacaacagtagtgtaaaaacagtttgtaccctcatagagtttatgttctagtagggaagatggtcaatgaattatgaggcagatggtgataggtgcttagaagaaaaccaaactgagatcaggggtgagtctaatcagaagccctccccttaatttattcatttgttgatgtatctgttcatttatttgtttaatgaataattgttgatcttaagcaagacagtttactttctgctttcagtgacttatgtaagtggttgtatgaactcagaactagttttctcatacaaaaaaagttaaacaactaaagttaaattcttagctggctcacagaatctccttgaacccatgttaaaaatttcactgtggtactagataggagactccactctggttcttaggaggacagaaccaaggaaaatgagagaaaatgggagaggagtcttttgctgtagaattggcagtcatcttttagggagatttttaaataagtagttttggtttcacattcttctatcagattttcaccaccttagacttcccctgtttccctcgctgcctttttcagtcctcctttctcctccccgcagcctgctttactcataaaaaggctttgtggcattctagcattttcttagaggggagcagtttgactgaacaacttcttctagtgtatgaatgagacataatataagcataaccctaacctgaacgaaggtatttgcatttctgaagaggacacttgaatcactaattgctggcattttgagctacctgaaaaagctattgaaaatcctcagagaatgtagaggacctactgtgggcaggaggccattgggtctgtcagaaggccaacaattcctttcagtctcctgcccaggtaaggtgtgcagccttgctttttactttttctcttccttccatgaaaaaactggtgtttcttttttgttgttgttgttttctcgatggctctcatgcatttttattttctgccttttataagctgggtggttgcaaatgaggtagtgtggatagggttcatgctcctgaggcccatattctggcctgtcagcatgttgagcaaaacaatgacaataacaatgacaatattaatgactatgttttctgactgcctaagtatctagtatttcacatatattcatgataccatttggtctttactacagtcctgaagggttctaagaagaccatttgtagataaagaaggcaagggaggtgagaggttaagatatttgcccagattacagggctagtaaatgcagttgggtttgatcacacttgggtttgtttgatcctgagtctcttttcttttccctactactgtcccagaaataagtgactggtgattccagaggactgttcccttgttaggctcgagctgttttaactcaggatcaccaagtgactcttgatgtctgcataccgaggcaaatggattaggctacagaagaaagacttggagcaggagttccagggagtgattttactcatgttagcttaccagcctcagagatgtgcccgggagtctgttccattttaggtacccaaacttcagcaggccttcaggacccatggtacttggactctttcctgacttcatggtatctgggctccttctctcttgagtatttagataaacacatgaacagtcgttagtgcattgaactcacgatacattgattggttcctcttgtggtattaacagagcttttgctgcagattttactgacagataaaactggcactaaaattatctatttgtatttcctctccatgagacactttcattgattgtttacttttatcccctataaaaatacctagtgagaatctgtgtttttagtgtcttttttgttctgcttggggaccatggcaaacctttggttgggttgtacaatcagttattcaagtatttcaacaattggctgcattaatttttttctttttcaaagggattggggaattggcagtggtgctcaggttgctgtatttggaatatagaatgtctgcttgtctcaagtgaaaaactccttgtagacttggaaaaagagtttgcctttgactcataggctggtacctattttttgattttctagcatttttccaattggcccattcaacttctttataccctttgtgatgtgaggtatcggatgcaatattctttgtatggtgccatcctcatccagatgcatatgttctagtgaagccaaactgaaggaagagaatgactctattatgtggattagtgtgcatatattagtctattttcatcctgctaataaagatgtacgcaggacgggcaatttacaaaagaaagaggtttaatgaacttaacagttccacatggttgtagaggctcacaatcatggtggaaagcaagaaggaacaagtcacgtcttacatggatggcagcagcaaagagagagagcttgtgcagggaaactcccatttttaaaaccatcagacctcatgagcccactcaccatcaggagaatagcatgggaaagactagccctcatgattcaacagtctccactgggtcccttccacagcatatgggaattatgggagctacaagatgagagttgggtggaactctgagcccaaccatatcattccatccctggctcctcccaaatctcctgtcttcaatttcaaaaccaatcatgccttcccaacagtcccccaaagtctttactcattttagcataactccaaagttcacagtccaaagtctcatctgagacaaggcaagttcctttcacctatatcctgtaaaaggcactgggtaaatacagctcttccacatgggagaaattggtcaaaacaaggggctaaagaccccatgcaagtctgaaatctagctgggcagtcaaatcttaaagctcaaaatgatctcctttggccccaggtctcatatccaggtcatgctgatataagatatggttcccatggtcttgggcagctccgtccctatggctttgcagggtacagcttccctcctgctgttttcatgggccgacattgagtgtgtgtggcttttccaggtgcacagtgcaagctgcaatggatttaccattctggggtctggaggatggtggccttcttctcacagctccacttgtggtgccccagtagggactctgttgagggctccaaccccacatttcccttccacactaactagcagagtttctcaatgagggccctgcccctgcagcaaacttctgcctgggcatccggcgtctttatacatcctctgaaatctaggcggaggttcccaaaccccagttctttactctgtgcactcacaggctcaactccatgtggaagctgccaagacttggggcttcaacccttgaagccacggcccaagctccctgttggcccctttgagccatggctggagtggctgggagcagggcactaagtccctaggctgcacaaagcatggagaccctggactcagcccacgaaccactttttttctcctaggcctctgggcctgtgatgggagaggctgcagtgaagacctcgacatggtctggagacatttttcccattgtcttggggattaacatttggctacttattattatgcaaatttattcaaccagtttgaatttctcctcagaaaatggtactttgtttccttcacattgtcaggcggcagattttctgaatttttatgctctgcttcccttttaaaactggtgcctttaacagcactcaagtctcctcttgaatgctttgctgcttagaaatttattctctagataccctatatcatttccctcaagttcaaagttccacacatctctagggcaggggagaatgccaccagcatctttactaaaacataagagtcacttttgctccagttccctacagtacctcatctccatctgagaccatctcagcctggatttcattgtccatatcactatcagcttttggtcaaagccattcaacaagtctctaggaagttccaaactttcccacattttctgtctctgagccctccaaactgtttcaagccctgtctgttacccagttgcaatgtcgctccacatttttgggtatcttttcagcagcaccccactccaatttactttattagtctgttagcagcacaccactccaatttactgtattagtaccaatttactgtattagtcttttctctgctactgataaaaacatatccgagactgggcaatttacaaaagaaagaggtttaatggcttacagttctacatggctggggaggtatcacaatcattgtggaaagcaaggaggagcagttacatcttacatgggtggcagcaggcagagagagagagcttgtgcagggaaactccttttttaaaaccatcagatctcatgagacccatccaccattatgagaacagcatgggaaaacctgcgcccatgattcaaccatctcccaccaggtccctcccacaacacatgggaattagggagctacaagatgagatttgggtggggacacagagccaaactgtatcaatgcagttctgatgtatcctctattatcaaagatgaatccttccacaagtgtaacttagcgtcagaaattcaccactggtaaatgacatggaatatagtgcaaagaccttcggtgtaggaatgcagaggttcatgcatgatttcatctctgccactgtctagaaatataagctttgataagtttgttattttgtgggccttggtttcctagtttataaattaaagctaaagtaatcatctctgccctgtctagaaatgtaagctttgataagtttgtttattttgtgggctttagtttcctggttacaaatgaaagctacaattaagatagcctttaaagctgtcattacattctgtaatccaggctgaaataaaatagggtgcacagaagtgcattattgcagtaaagttataggactttcatgtctccctttatgtttgtcagtttttgcttcatataatttgatgatctattattagggtatgaacatttatgattgttatgttttcatgctgaattgaaccttttatttataaatatattcattgtctcttgtaatcttttctgatttaaagtctattttgtctgatattaatatgctacttctgctcttttttggttatgatttatatgaactatcttttttcatcctttcacttcagtttacttgtgtttttcaatctaaagtgagtctcatgtagacggaatatagttggtcatatgttttgatccattctactgatcttggtatttttgattggagagtttgatctactacattcagagtaattactgataaggagggatttactttgtcattttgctgtttgtttttatatgctttctagccttctctcattttctgcattagtctccctttgtgtttcattgatcttttttgaagtgaaacatttaaatttcttttttgtttctttcatttcattttcttttcaaatctaatttgattttatgtcagattaacttcagtaacatacaaaaactatacccctttacagctttgttcccaatcctttcagtttttgatgtcacaaaattccatctttatcaaattgggaagttttcatccattatttcttaaaatactctttatgcctctctttctctctcttctctctctcctccttctggtactcccacaatgcacttgttagttcacttgatggtgttcacaggtccctttggctctgttcacttttcttcagtcttttctctttcctttcctcagatagatatttccagtgttctatcttcaagtttgctgattcatctgcctgctcaagtttacttctaatttctctagtgtgttttttattttatttattatacttttaagcatcataatttctttttcttttaggttctctgcctctttattgatattttcattttatccacacattatttctcaacttttattttagattcaaggggtataatatgcagattttttacatgggtatatacatgatgctgaggtttgtggcatgatttaacctgtcactagggcagtgaacatagtaccactaggtagtttttaaacccttgtttctctccatcatttcccgccttgtagtctccaggtctgttgttcctatctttatgttcatgtgtacccagtgtttagctcccacttgtaagtagaacatgaagtatgtggttttctgtttgtgtgttaatttgtgtaggataatggcttccactccatctgtgttgctgcaaaggacatgattttgttcttttttatggctgtgtagtatccatgatgtatatgtaccacattttctttatccagtccactgttgaagggtgcctacgtgattccaagtctttgctattatggatagtgctgtgatgaacatataagtgtatgtgtcttttggtagaatgatttattttggggtttacagatccagtaatgatattgctcagttgaggatagttctatttttagttctttgagcagtctccaaactgctttccacagtggctgaacagtttgctttcctaccagcagtgtgtaaacattccattttctctgcagacttgttagcactgttatttttggacttcgtaataatagccattctgactggtgtgaaattgttggtatccattgtggtttttgatttgaatttttctgatgattagcgatggtgagcattttttcacgagtttttggccacttgtatgtcttctcatgagaattgtctatgccttttgcccacttttaatgttttgtttttgtttttgttcttttgcttgttgatttaagtttcttacagattctgatattagacctttgtaggatgcacagtttgtgaatattttctcccattctgtaggttattgtttactatgttgattgtttattttgctgtgcagaggctctttagtttaactgaatccacttgtcaatttctgttttcattgcaattgcttttgatgacttagccataaattctttgccaggccaatgtcaagacggacattttctaggttttcttgtagggtttttgtagtttgagttttatatttaagtctttaatcaatctttagttcagggtccaatttgattcttctgtgatggttagccagttatgccaccaccatttattgaatagggagtcctttccccattgctttttttgttgactttgtcaaagatcagatggttggttgtgtgtggctttatttctgggtctctattctgtcccattggtttttttttttaatttttttttgtctgtttttgtgccagtatgtgctttttttggttactgtagccttgtagagtagtttggtttgaagtcaggtaatgtatactcttggctttgttctttttgcttaggattgctttggctatttgggctctttttcattccatgtacattttagaataggttttttttaattcatgaaaaatgagattgctattttataggagtggtgttgaatctatagattgctttgggaagtatggccatttttatgatattcttcatccaatccatgagcaggagtgtttttccatttgttgtgttatctgtgatttcttcagcaatgttttgtagttatcctcctagagatctttcaactccttggttagatgtattctaggtactgtgtgtgtgtgtgtatatgtgtgtgtgtgtgtgtgtgtgtgtgttttgaatgggttgctttcttgatttggctctcagcttgaatgttattttgtatagaaatgctactgtttttgtatattgattttgtatcctgaaacttgatccaagtcatttatcagttccagaaccttttgatgggatctttagggttttctaggtatagaatcatatcattagcaaagagatatttgacttattctttttctttttctattttgatgccttttatttctttctcttgacttttggtctgactaggacttccagtactatgttgaataagagtggtaagaatgtgcatcttgtcatgttccagttcttaaggtgaatggtttcagcttttgtccattcagtatgacattgctgtgggtttgtcatcagtgtttcttactattttgaggtatgtttcttgatgcctaatttttgagggttttcatcatgaagggatgttgcactctctcgaaagcgttttcttaatctatgagatgattttatggtttttgtttttgattctgtttacgtgggaaatcacatttattgttggcatatgttgtaccaaccttgcatcctgggaataaagtcgactagatcctggtaaagaagattttatgtattgttggatttagtttgctagtatattgttgaggatttttatatcatattcatcagggatatcgaactgcagttttttttttatattatcagaatgatgcttgattatagaatgagttaggatagagttctttgcctctattttggggaatagtttcggtgggttggtaccagctcttctttgtgtgtctgatagaatttggctgttaatccatctgtttaggcgttttctgattggtagttttttttttgttgttgttgttgttgttgttttacttcactattcagttttttaactcatgttctgttcagagtttcagtttcttcctgattcaatcttagaaggtgtctgttttgaggaatttatctggattttctagtttgtgtgcatagaggtgtatactccactcttgcactgctataaagaaatactttagactgggtaacttataaagaaaaaggtttaattggctcatggttccacaggctgtacagggaacatggctggggaggtctcagaaacttacaattatggtggaaagtgaatgagaagcgggcacgcatgtcttcacatggcagagcaggaggaaaagaaagaggagggaggtgccacacacttttaaataagcagatctctgaggactctgtcatgagaacagcaccaaaggggaaagtctgcccccatgatccaatcattcccaccaggccccacattcaacactgggaattataatttgacatgagattttggtgggacacaaatgcaaaccatatcaagaggtgttcataatagtctctgaggatcttttgtattctctgggattggttgtaatgttacatctttgtcatttctgtttatgcttatttggaactctgttgttgtggttgttgttaatctagccagcatcctgttgatcttgttatcctttcaagaaccaactttggtttcactgatcctttgccatatattattttattgactttatctactcttccttcagttctttgagcatctttaagacagtcgttttgaagtttttgtcaggtagtctgtcatcaggtgttttttgcagacagtttctgttaattaatttttgtttggatggatatagttttctgtttctttgtatggattgtgattttttgttgagaatcagacacttgaattgataatgtggtagctctggaaatcagattctctctctttttcagggtttgctgttttgttttttttttccttatactttttaaaattgttgtaggctgtctctgtgccaaggatcaactgaggtgtcaacttaaggtcttttcaagttccttctgagcctgcacaatcactttctattttccccatatatgcagttgcttttgaatgttttagtctttaatgcctggctttcaaaaggaaaaaagtgaaaaataaagtgtgtgtgtgtgggtggagtgggaagagtactggcccttaattcttctggacgtcacttcagcttgatggaaagggttttgagagagtggggagagtgcaataatggccatccaccttttgcatctttttgatcagaagcagcaatcagcaatcaaacacagatctctgatatttaagacagtgtcctttttgcccatcttggctcctataagcgtatgcaagtttctgtatgaacacaagaagagctgcctgccataggactgggtgtgggaatgagtagttgttactgtgtaaagagctgacattgaccagaattaaccctcattgaccaccaagcattcttagtcgtaagccttcaatagacatcagagttccaaaataattatgtaaacctattctgccagtgtaattgttgtctagatggggagacaattcctatgcttcttgctcaccatcttctgccaatcctagagagagtgaaaggttggtggggggggagagagagagaagaacacgcatgcatgcatgtgtgtgtatgctttaaatagaaagtggagttcaagatcttggattggctacaatatcttagagacacttcctgccccttcaagaacatagcataggaactgaatttaatgaggcctttgtgaaaggcaatggaagcatgaatcttaaacgggctagcgatatttcagaggattgtagttgctttgatacctgtttgagcataactgaatccttttgtagtctgttgcatgaaatatatgatcagagtccctacaaaaaatagaaagctgtaaacagtttaaagatttgtttttttttaattttgtttttgcacttttgtagttgatgattaatatcagtggatcacagtgtattagaagatttcctttcctacctgcttgtgatgtccagggagtaaatttagactcttcacttacttctcactattggaggttgctaccaaaaaagaacctatgttgtatatggagaaattagcttagataagtttgcataagaggcagaaaatctcaccctgccacttactcagctgagtgatgagttgtttagcatttatgggtcttgttttttccattatacattaccacaactcattgtaattactgtggtaatatatgcagtgtccttggcacgctcttggaacaatggttagaatgaaggagggtgggttgattatagttaggatttgcctgcacattcatgcctgagaagatcctggaagaagctaatgcataatgttagacacaacccccctgcagtacaggagttacagaaattgctggggcacctgatccaaactgggccaatcaattatctttcctagggatttggctatcgaccctgcagttggtctctatttgtagcctgactgtgtaacatgtttaaacttgggagctgtggggttttccagcatgaggtcactttaaccaggtgtcatgcttgacttctctctttcacatttatcccatatccagttcatcagcaaggctttcagctgtatctttacaatgtatcccaactctgactccttctactcatttttatccttccttgtccttgccactgtcactctcacctgccagtcaaccagctaactggtctctgctctgtctttgtctgtgtatgattcttttctactcagcagtcagaatgatccttctaaatgagcccatcatgttcctgctctgctataaaccttctgcatggcttccatctcattttcgtgaaaccaaacacacttaacctggcccacaagagcctgcatggcccagcacctggctgttgtgtgccatctgtgacttccctccttgctccttccagtcctgctccttgctgttgagtgtgtatggtgcagggcttttgcactcattgagccctctgcctggagtggccttctcctgatattcatagggtaacctctctccctcagtcagagctacagctaaacgtcacccctcagaagaccacccttgaccaaattcaaaatactccctccttcccttcatgtttcattttttcttatcagtttttttggagcacttattaccacctgaaattgtatttatatttgtttgttatagtttctcacagtaaaatgtaagctccataaatcagggatttttcttgtttataccttatcctcagggcctagaagaatgcctaacatcagtaaatgttgattttagtttgatattaatgaataaatatgagcaggaactatcactacttagatgttgaaaaatgcagtactggtgggtataacatgtatgtatagtatatttccttaaatttaaggtttttaaattttattattgaaatcaagttacactttacaattgatgcctgtatttaatatggtaagataaactcctagctgttattaaatagattcatcaacaacccattttagattgtaaattttaagcaacatctgggcctccagttggcaggggaatcagtacatttctgttccataataaatatttaatataatagatgcatagtctgttgttcagaagtgtttgtgtttcttcaaccagatagaggttttgctggttattctatagtattctatgaacattaacgtattcttagacattatttctgtatactgtaaactatgattgtactacaaatgctacatgggtagtgattttttttagttgtttagttttatcaagttagcaaaatatgccagcatgcaaaatgtgagattatctaagtcaactattaaaattatatgccatcttccatttacttgtgtttttggaattgtacatttattctatcccattgtcttatgcttagagtttatgtaagtattttccaaatgttgaacttcaaacaaaaaatgtaattttgcaacgatttttaaaagtatgttttataacctaataattctggaatagtcatattggtagtgtgcttataggtggtaaatactttaaacatgtacagatttgtgtctaagatagtatagctccttaatattcattaacaaatagacatttatttaattaactctgaataatttagttttttaatttaactttaagcattttctttacagaccagttatgtttagtagcactcaacaacttgacataccttcaacaagaaaacatttgtatctttagaatgtaaatattatccagcattgtagaaaaattggagaacatagaaaacagtcttggcagtactactagatgctttcctaatttagtctccttttcttcattaattagaaaaaaagacagaataataacaagttagattggcatgctgcacacatgtaaagactgtatttccttgctgtctacaggaggttatgttgtagccagaaatgttatatggtcattatggaaaattatcttacagcaaaggggtgcctttcttctttctcttttcctccatctttctgaccagaacggatactgatggacaaagctccacagccatattggaccatggtggcagaatgagtaactagaggagactgggccattaacaacttggtataagcttctgccaaccttcagacttcgaattttcatgtggaagaaaaataacttccgtattgattaaactactgttatttgcaggttatcgatatctgttatcctgctaaatggggataaaaattgctttctttcttacctatgtctatgtagatatacatacatgtccatacattacccacaaacccacatagagtgaggctaaacagttatagtacactttactgaatttatatatttttggctcatcgtatgtgctcattgttttccatattattaaaattatttttaaacatttttatatctacttaacatgggtatgtaccatatttgttgaattggttcactctttttagacaattattttgtcttactatatagaagtcttttaaaatctatcctagcaatatttttcttccattttaacttagtgagtatttcttatgcaaaagttctatttatacacaacacgtgcaactcactgtcacttctccaagagctcttcttctgagaaagttgtcctagctttgctgcacttttattctcctctagttccttgcacttgctctaatatatcactggcatttctgcaatagttatttattttcttccaagtttccctcattgcccttaaagaaaatctggagccaggtttgtttactgccaaatacttggttcacacattatcccaggccctccacacaatagctctgtgccttttctaagcttgaccttctttatctaaaataggtttatttttctcactattagtatcttgatgataaatgagattatatttatcattttttactacaatactggatccaaggttgacatgcttaattgccttcaagtctgctgaatgtcatcttttcattgaagcctgtcctgcagctgtgtttaagttgcaaacaactttactattactcttaatctcccatactgttttctctataacatttaccattttctaacatatttataactcatttatttattattaggtctattcattatgtgttactctgcaccagagtgaaactccattgtaggtaggaatgtttgtctgcttttgcttactgaagtcaagttcataaatagtacctggcacatagtatagatgctcaataaatgtttgttgaataaatgtgttcattaagatgttttgaatgcataaaaatgtttgactagccatttagaattttctctccattgtggttttagagactctgtaaaagaatctctaactttaccaggctgtagaagacattttcaggctctatatcctgtttttttgtcaatatctgcagctctttgggtctggtacctatatttataccttgcacttatcttccatatttattttctggagctgccataaaaaagtcccaagaatgggtgacttaaacaatagaagtttattttctcatgctcctggagcctagaagtaaagatcaagatgtcagcagggttggtttcttctgaggacctctctctttggtttgtagaagccatcttctctctgtatcttcacatggtctttcctttgtgtgcttctgtggcataactcttcttattataaagacaccattcatattggattagggcttacccatttaccttaattcctctttaagggccctgcctccaaatacagtcacattctgaggtactaggagttaggactcaatacacacattttggggataaacaattccgttaataataccttctatttctctggcggctctttctataagttgcttggttgggatgatttgtttgagtttttgtttaccatttccttttggatactgtctttttcatgaccttttgctccaaagtttgagttgccagccattcctcttccctgctatacccgctccccacatttaaccctctgcctggtccatactcccagggtctttcagaaaaagcggttcaaaggaaagactattttcatgcttggtatgctcataatctgtagacatatcagtttggaggctaacatgtgtcaactgatggacaattagcatacagaaaggattagttaattaaatgtttaaggaacatttcaccagaacagtatgacagtttggtggtatgtatacccaaataacatagcctttaaatatctaaacaaagcaaacagaataacaggagaaactgacaaattctcaatgggaataggtgagtttttagcatatagtcatgcacgcataatgatgtttgagtcaacaatggactgcctatacaatgatgttcctatgagattaaatggagctaatgaggataattcccgtcatctaatgacatcataactatcttaatgataagcacaacacattactcatgtatttgaggtgatgctggtgtcaacaagcctgctgcattactgccagttgtttaaaatatagcacataccattgtttgcagtacataatacttgaaaagataataaactagtatattgctgatttatgtatttgctatactatactttttatcattatttagagtgtacttccactgatgtaaaaacaagttaactgcaaaacaacttcaggcaggcctttaggaggtattccagaagaaagcattgttatcatagaagatgacatctccatgcagttattgtccccaaatacattccagtgggacaagatgtgggattggaagacagtggtatgataatcttgaccctgtgtaggcctaggctaattgtgtgtttaggctaatatgtgcattgtgccttagtttttaacaaaaaattttaaaagtgaaaaaataatttaaaatagaaaaaatttatagaataagtatataaaaaaagaaaattttttttggggtacagctgcacaatgtgttgtgtttcatgtaagtgttattacagagtcaaaaagttttaaaagttaaaattaaaaatttaaaaagtaaaaacagtcacagtaaggaaagattaatttattattgaagaaagaaaaatttaaaaataaagttagtatagcctttgtattagtctcttttcatgctgctgataaagcatacccgagaccaggaagaaacagaggtttaatggacttatagttccccatggctgggaggcctcataatcatggcggaaggcaagaaggagcaagtcacatcttacatggatggcacgggcaaagagagagcttgtgcagggaaacttccgtttttaaaaccattagatctcgtggacttattcactattatgagaaccacatgggaaagacccaccctcatgattcagtaacccccaatgggttcttcccacagcatgtgggaattgtgggagttagaactcaggatacgattgggtgaggacacaaccaaaccatataattctgccccggcccatccaaaatctcatgtctttttacatttcaaaaccaatcatgccttcccaacagtcccccagattcttaactcattcagcattaactcaaaagtccacagtccaaagtctcatctgagacaagcatattgtcatgaacaaggcaagtctcttctgcctatgagcctgtaaaatcaaaagcaagttagttacttcttgatacaatgtgggtacaggcattggataaactcagccattccaaatgagagaaatcgccaaaagaaaggggccacaggccccatgcaagtccagaatccagcagggcagtcaaatctaaagctccaaaatgatcctctttgactccatgtctcacatccaggtcatgctgatgcagaggtgggttcctgtggtcttggtcagcactacccctgatacggtttggctgtgtcccccccaaatgtcatcttgaattcccacgtgttgtgggagggacctggtaggaagtgattgatcatggggtcaggtctttcccgtgctgttctcgtcatagtgagtgggtctcaagagatcgattttataaatggttttataacggggagtttctctgcacaagctctctttctttgcctctgccatccatgtaagacgtgacttgctcctccttgccttctgccatgattgtgagactccccagccatgtggaactgtaagtccattaaacatctttcttttgtaaattccctcgtccaggtatgtctttatcaggagcatgaaaacagactaatacagtaaattggtaccaggagggggtgctaatgaaaagatacccataaatgtggaagcaactttggaactgagtaacaggagaggttgaaacagtttggagggctcagaagaagacagagaaatgtgggaaagtttggactccctggagacttgttgaatggctttgacaaaaatactgataatgatatggacaatgaatccaggctgaggtagtctcagatggagatgaggaagctgttgggaactggagcaaagggactcttcctatgttttaggaaagagactgatagcattttgccctgccctggagatttgggaactttgaacttgagagagatgatttagggtatctggcagaagaaatttccaagcatgaagcattgaagaggtgactttgatgctgttaaaggcattcagttttacgagggaagcaagtatagaagtttgaaaatttgccgcctgacaatgtgatagaaaagaaaatcccatttttgaggagaaattcaaggtggctgcagaaatttacataagtaatgagctgaatgttaatcccaggacaatgggaaaatgtctctagggcatgtcagaggtcttcatggcagccctcccacacaggcccggaggcccaggaggaaaaaatggttttgtgggctggtccaagggagcccagctgtgtgcagcctagggacttggtgccctgcatcccagctgctccagctgtgtctgaaggggccaacatagagctcaggtcatggcttcacagggtgcaagcctcaagccttggcagttccacatggtgttcagcctgggagtgcacagaagtctaggcagaggtttggaaacctcgcctagatttcagaggatatatggaaatgctgggatgtccaagcagaagtttgcttcaggcagggccctcatggagaacctctgctagtgctgtatggaggggaaatgtggcatggagcacagagccctactggggcactgcctggtggagctgtgagaagagggccaccgtcctccgacccccaaatggtagatccattgacagcttgcaccgtgcaccccggagagtattgccagaactttgcctttggcaggtctgcttttgctttgacagatccacttccacttcttggtaccattgctttgattgtgctttgttttcaggatagtactggtggtaccatgattcatctctattacaattctttgaagaaatgcttcaggatcatgatcacagttgtttaaaatttccacaaaagctctgccattggctgtagctgatctgggtgcaaaagttttggcatccatcaacggaaaatttagtcaactttaatttttcagtaagaattgtgcaagttgaaccacttgaaagtctgtggtgttatgtctgctgttaatcatcagtcttcttcaattagggcataaacgagaattttttttttcgtttattgatgtgaatggtttgacattgtgggctttatcttcaacatgtctcatcccttcttaaaaggattattcatttgtaaactactgattcttttgggcatttttccctaagtttttccataaagcatcagtgattgcatcattcttccacccagtttttacataaatttgatgtttgtttttgcttcagttttacagaattcatgttgctctgatagggctcttttcaaacccattacttagtcctcttagtgcctcaaactagatcctgttcaaacagttatagcaagttagtatgagtttagtttggtgcaaaaattttgaaatttatgcatagttcttaataatatgcattttccatgaattatatcttgcatttatatatatatcctcttattatagatccctgtacccaataattagataataaaccatgttttcaattttacagtgaatatgtggattgagtaatgtggcatgaagacaactcaataagcagcaaatatgggtatcatcagagaacttttttttgatcactgtgcaattaaaagccaataaccaaaagcaagctaagaaacctcttatatgtctaaaaactatttttacaaaactctatatttctaactaatttctggaaggattatacagggggcctcaattctatctgtaatttttaattccttaataaacaaagatgtgaagcacttatggcttgatattaagaatggacaaattgagttggtggtctgttatgtttgcttgattatactctgcagttttctattttgtatttttttaattaaaaaagatagtgatttctaaccctatgctcatgtatttaaactttaagtatgagggcagaactcaggattttcccatatttaggggtccaaaaatttcatccccctaaaacctatctaaaggtatttaaaaatcaggaaaacttcagaatccatttcgcttcacaaagcatgctgaggtcttctctgtgaaaattagtatgtgaatgcaaacagggggagttttgtgctgtacagtttcgtgcttgctgagaaatccagatagtttcccaagcccacagcaatgaaggaacagtattttctaagtagtaccatattgactaatcaagaatgtttacaaaattggtactgatggagtaaatttccataccccaaattaattaaaaagctttttacagcaatgcttgaaattcattcaaatctcctaaaatataggtatacagtattttatatatatgtttgtgcatgtcacagtaagtacattagcaaaccttaatgactcttactgatggttgaggatcaatgttttagttatgattaccacatgaattactattgctgtatatattgctataattaatggtagtactttgtgtttgatttacttatgtaagctttaggtataaaatcagaccttgtattgaatttatacttgacaagccatagattataaatactcatttaatataaatctttaatgctactccatttcatcctatttgtctttcttgaaagtaggtttttagttactcaagagtttttacaaatggatgtgatacctctttacttttatagtgttaaatagtaagcttctttaaattcacataagaaagctgataaacaatcatagtgctaatggctagtatttattagaaaatagttgattgaaagtgcatggtttatgtattatgaaccaagttaaattttttaaggcacatcagtcatgtacttcatctgtagcaaagcatgaagacctaaaactagtagagtttgtttgttcatttttgtttttcattagttttggaaatagtttcattttgaattctttaaaaaaaacaccttatgagaaagagggtacttagttgcctttcacttcttttacagttggtatacttctcggaattatttatgtgtggaggtgcatgaccccttttacagtttttagggccatttaaggtcttaatccagcctagatataaagatgtcttactgggtaaggaagtatatggaattattttaactatactcacagaaactaagccagaatgtaaggtaaccatcctgtgattgtgattttattatgaatttatgagtacttcatggaatcatgtggcctgccatttctttctttaacttctttccggctaacttaatcgtaaccttgtctagctcactcacctgtggccttcccactcttagcattttcttggccctaaggcattcaggtttcattgctaacccaacagggccttcatgatgcccatggctcccctttcctgaaatttggaccttctcatgtgactggtcttcctctcagaaccctcctaggggaggctgcttttctcattgcctttgactgagcatgaggaggaggtgttggcaacttttgctcctgagactgtggttctgcagtttctcagcagttgtagttcccactgcctatcacacgaactactcatttcattagcatggtctggtggactctgaaaacattgttctagacccaagcttgccagtatctggcttacagctctctttacctgtcacctgccatcattctcaggagcaccccacctacaacgtgactaaatagttcctcaagctcctgcaaaccactgacactctttcagcccttaaccttgtaataaacttttcaggctccatcctacttccagttacatattaatttttctagttcactgctgtgacttcagacttaatggttcaaaaatctttataactcttcacagttcgccagatagaataccagaacctcagtctgagctcagcccctcaatcagctccagcttgctttccaaacgtgtttgttttgcagttgggtagctgtatttgatttcccaagcagacctctttttgtttgaaatgccttctctgtagtctgttttgatttagtatgctctcatgtcacctcctctgtgatgcttgtcttgattgtctcatctggggagacattctttcttctgatctcccatgatacttagctcataccttttaaataatatttcttatactttttacttttaatacattatattgggttttatgatgacttgaactatgaaaaggggtctggactagaggaagaatatattactggttaaacctagatttaaaagtattttgttcaggtgggtgtggtggctcacgcctgtaatcccagcactttgggaggctgaggcgggaggatctgaggtcaggagttccagacaagcttgaccaacgtggtgaaaccctgtctctactaaaatacaaaaattagctgggtgtggtggcgtgtgcctgtaatcccagctactcagaaggctgggcaggagaatcgcttgaacccaggaggcagaggctgtggtgagccaagatcgcgccacgcactccagcctgggagacagagcaagactctgtctcaaaaaataaataaataaataaaaaagaaaagagtaatttgttcaaaagcaaagcctggaggtgaccagatttcaacgaggcggtcagtggaaactggggaaaggaatctttcgatgagaaggagcaaatttttagtcaaattggtttaaaataataactaatttctctagatctacagtattatggttgtgaaggtaaatgtactatgtacttacaagtttttaccccatgagaaagcaaaagttgaacctgttacttgctttcaattgttcaagccaataaaagaaggaaagagatgtgagatgcaaattattattgtgtccatcggcacaaccaagatggtaagcaaaatcaatgaagggttttgatcttgtttctttaaatgccccactatttccataaaatgaatttgttttttttcagtatatgaacagcttcacagcatgagtacatgacacatttttaattaaatttacttgttggttgggattcctaatttgtttgtatttctttgtatgttaattttaattcatcagattgtaaactcacaaattggaaggacaagttagttccgcagagaaaaaaaaacccaggtctcagcactatgcaactaggtctctttagctgtgtaataggaggtaatcatggcatttaaaaacattgactatggattctctgagtaaatgagaatattagctccaccacctttatccgtatgacttttggctaatacttaacatggatgagtcagtttcttcctttctaagatgggaataatagtatttttacttatgggatgtgtaagcacaaaatgagataattgttttaaaatacttaccgtagtgcctacaggtaagaattgccccataagtttagtagtttattattgtgattggcattttagtattctcttacaagatcaataacactaatatttagtaaaatagaaaaaaaatggggagaaaattattattatgtttattatagtaaattatctataaattgaacatccaaccattaaattataagagtatgcttttgttaattcactttgtttctaaaatttagggctagctaaacccagatttagttatatatgaggacttgggttaatgaaaaaaagatatttgattgaaatatgtatatttgcactatataaaacaaactaaagagaatcacgttagagggaaaaagtcagttaaaatcaggcctctgtttcaaacaaatgagaaaaaatggaagttccacaacagtatgtcaaaatacaaacaaagtagatcaatggtacagctatatttttgcccagatcacaacctggataacttattcttctactaaaacaatgaatggctaacagcttctgtctagagcagagacagttgataaaactcaatagtgtttttactgagaaaccctacttaaaaaatttgtgtaatttaaacaaattaaagtttcatgaacacatagtatttaatgttaaaattcatataattacttttaaaggaggaataagtctcttgtaggaaatctgtggaggggatctccatcaggggaagttgagaaggacatgttctttaggaagtgagctgtgttccttttctctgtattttgccttagaggtttgaatagctactctcttgagagcttttctttttttcttcctttttttttcagctcgctgctgtctagtctgtaatgggtctgatggatagaaaatagaggagtaaaagggatgcttttttatatatgaaattgaaattggttgaattcaacaaatagcaatttcattgtaaggaagataagtcaaccaaagtaaagttattttgagatcactcagaaaatggatatggatcaattgtaaagtagaatactatattataaatattcttatactgaaatgtttcctacttatgggaaaggaaaggctgttcaattctgcctgttctagaagaaacaataaatacctgtcgacatcattagaatccatttcctctgaggcacactgcctttgatttgttagtaatggttttatttcagcagatataatatattaaaggagggaagttgcccatcccattttgggtagcgaatgttaaaatgaaattttagtttcatagctgctgtaagtgcccctttgtcttttaagatagactgtatgtgtgtactttaacaggtttattataaaagaatagaatttcgacaatcttttgactaattatattatcttatattgaaagaaaataaaattgatttacctgtggttaacaactaatggtaggttgttagatgtgtagagctacttaacatactatttattcattcaatgatttcccaaagaataacctgggacaggataaacattctttaggagccacctttcaaagttagattgttttttaccctaaccttttgagatatatttttaaagaaatattttatagtaataagttgtagcaaaaattaatcttgttcttataattgcttttcttacatactattctcaagtgtgtatatagcttgtatttccaacttcgcagggagcttaaagataggaagtgtactatggaggttacctcggtaataaaaaaaactgacttgagagaaagaaggctgcatatcaaagtgtgatacctaggtacaaaaggaataaaataaaattccacaaatggggccattataaaatttatactagtacgtcactgggagccttgttaagatggataatgttattttaataaaattgtaaatatttcaatatttttactttaaataaaaggatagaaaatgaaaggatattccacttaaagcaaatgaatagtattcaaattgaaatagtcattctggagcattttgccaatgcaaaaagggaactagtctaattcgtgttctcctcagttttctctgaggaggttaaaataagggtgtccatttataagcattttggatgaaaaacgtatggttacataaatttgttttattgagctaaataagaaaaggtagataaattttataccaccagtaaagtctctgttaataaaggatactattaaaaaaactaaaggccaatttttgtctgaaggaaaacaacatcataacagacaaacagaaaagtcttataaatcaataagagaaatgcaaacatgtcaatgagaaatgcatgcatgataaactaatttaaagaaaaggaaatctaaacaattaaattaactgcttgtggtactcagggaaatgcgtaaaataaggatgagagcaacatttcatatacccccaacagaagtttaagagttttgatgatgtcatgaattagagaagttttggtggtggtgtggggtgggaactatctctatattgggtgaaagtgtgagttggtacaatcgctttggaaagtatatggccgtatccagcaaagttggaaatacatagttacattgaatcagaaacttcgcagataagcctaaggagatgtgtgctaatatatccactgtagcattgtttgtt

(The sequence listing continues in the following parts.)

What is claimed is:

1. A method for reducing risk of liver fibrosis in a human, the method comprising:
   a) testing nucleic acid from said human for a polymorphism in gene DDX5 as represented by position 101 of SEQ ID NO:19179 or its complement by contacting said nucleic acid with an allele-specific primer that specifically hybridizes to C at said position 101 of SEQ ID NO:19179 or G at said complement;
   b) detecting said C or said G;
   c) identifying said human as having an increased risk for liver fibrosis due to the presence of said C or said G; and
   d) administering a therapeutic agent suitable for prevention or treatment of liver fibrosis to said human.

2. The method of claim 1, wherein said allele-specific primer comprises SEQ ID NO:34437 or a sequence fully complementary thereto.

3. The method of claim 1, wherein said testing comprises allele-specific amplification, and further wherein said detecting comprises detecting the presence of an amplicon.

4. The method of claim 1, wherein said allele-specific primer is detectably labeled with a fluorescent dye.

5. The method of claim 1, wherein said human is homozygous for said C or said G.

6. The method of claim 1, wherein said human is heterozygous for said C or said G.

7. The method claim 1, wherein said human is infected with hepatitis C virus.

8. A method for reducing risk of liver fibrosis in a human, the method comprising:
   a) testing nucleic acid from said human for a polymorphism in gene DDX5 as represented by position 101 of SEQ ID NO:19179 or its complement by contacting said nucleic acid with an oligonucleotide that specifically hybridizes to C at said position 101 of SEQ ID NO:19179 or G at said complement;
   b) detecting said C or said G
   c) identifying diagnosing said human as having an increased risk for liver fibrosis due to the presence of said C or said G; and
   d) administering a therapeutic agent suitable for prevention or treatment of liver fibrosis to said human.

9. The method of claim 8, wherein said method comprises nucleic acid amplification by polymerase chain reaction (PCR).

10. The method of claim 8, wherein said oligonucleotide is an allele-specific probe.

11. The method of claim 8, wherein said oligonucleotide is detectably labeled with a fluorescent dye.

12. The method of claim 8, wherein said human is homozygous for said C or said G.

13. The method of claim 8, wherein said human is heterozygous for said C or said G.

14. The method claim 8, wherein said human is infected with hepatitis C virus.

15. A method for reducing risk of liver fibrosis in a human, the method comprising:
   a) receiving an identification of a human as having an increased risk for liver fibrosis due to a polymorphism in gene DDX5 comprising C at position 101 of SEQ ID NO: 19179 or G at its complement; and
   b) administering a therapeutic agent suitable for prevention or treatment of liver fibrosis to said human.

16. The method of claim 15, wherein said human is homozygous for said C or said G.

17. The method of claim 15, wherein said human is heterozygous for said C or said G.

18. The method claim 15, wherein said human is infected with hepatitis C virus.

* * * * *